United States Patent
Wesche et al.

(10) Patent No.: US 10,815,311 B2
(45) Date of Patent: Oct. 27, 2020

(54) DLL3 BINDING PROTEINS AND METHODS OF USE

(71) Applicant: Harpoon Therapeutics, Inc., South San Francisco, CA (US)

(72) Inventors: Holger Wesche, South San Francisco, CA (US); Richard J. Austin, South San Francisco, CA (US)

(73) Assignee: HARPOON THERAPEUTICS, INC., South San Francisco, CA (US)

( * ) Notice: Subject to any disclaimer, the term of this patent is extended or adjusted under 35 U.S.C. 154(b) by 0 days.

(21) Appl. No.: 16/583,070

(22) Filed: Sep. 25, 2019

(65) Prior Publication Data
US 2020/0095340 A1  Mar. 26, 2020

Related U.S. Application Data

(60) Provisional application No. 62/877,227, filed on Jul. 22, 2019, provisional application No. 62/736,358, filed on Sep. 25, 2018, provisional application No. 62/736,368, filed on Sep. 25, 2018.

(51) Int. Cl.
| | |
|---|---|
| *C07K 16/18* | (2006.01) |
| *C07K 16/28* | (2006.01) |
| *C07K 16/30* | (2006.01) |
| *A61K 39/395* | (2006.01) |
| *C07K 16/46* | (2006.01) |
| *A61K 39/00* | (2006.01) |

(52) U.S. Cl.
CPC ............ *C07K 16/468* (2013.01); *C07K 16/18* (2013.01); *C07K 16/2809* (2013.01); *C07K 16/30* (2013.01); *A61K 2039/505* (2013.01); *C07K 2317/24* (2013.01); *C07K 2317/31* (2013.01); *C07K 2317/565* (2013.01); *C07K 2317/569* (2013.01); *C07K 2317/622* (2013.01); *C07K 2317/76* (2013.01); *C07K 2317/92* (2013.01)

(58) Field of Classification Search
CPC .............. C07K 16/2809; C07K 16/468; C07K 2317/31; C07K 2317/569; A61K 39/395; A61K 2039/505
See application file for complete search history.

(56) References Cited

U.S. PATENT DOCUMENTS

| | | | |
|---|---|---|---|
| 4,816,567 A | 3/1989 | Cabilly et al. | |
| 5,061,620 A | 10/1991 | Tsukamoto et al. | |
| 5,199,942 A | 4/1993 | Gillis | |
| 5,225,539 A | 7/1993 | Winter | |
| 5,350,674 A | 9/1994 | Boenisch et al. | |
| 5,399,346 A | 3/1995 | Anderson et al. | |
| 5,530,101 A | 6/1996 | Queen et al. | |
| 5,565,332 A | 10/1996 | Hoogenboom et al. | |
| 5,580,859 A | 12/1996 | Felgner et al. | |
| 5,585,089 A | 12/1996 | Queen et al. | |
| 5,585,362 A | 12/1996 | Wilson et al. | |
| 5,589,466 A | 12/1996 | Felgner et al. | |
| 5,759,808 A | 6/1998 | Casterman et al. | |
| 5,766,886 A | 6/1998 | Studnicka et al. | |
| 5,773,292 A | 6/1998 | Bander | |
| 5,800,988 A | 9/1998 | Casterman et al. | |
| 5,840,526 A | 11/1998 | Casterman et al. | |
| 5,858,358 A | 1/1999 | June et al. | |
| 5,859,205 A | 1/1999 | Adair et al. | |
| 5,874,541 A | 2/1999 | Casterman et al. | |
| 5,883,223 A | 3/1999 | Gray | |
| 6,005,079 A | 12/1999 | Casterman et al. | |
| 6,015,695 A | 1/2000 | Casterman et al. | |
| 6,107,090 A | 8/2000 | Bander | |
| 6,120,766 A | 9/2000 | Hale et al. | |
| 6,136,311 A | 10/2000 | Bander | |
| 6,326,193 B1 | 12/2001 | Liu et al. | |
| 6,331,415 B1 | 12/2001 | Cabilly et al. | |
| 6,352,694 B1 | 3/2002 | June et al. | |
| 6,407,213 B1 | 6/2002 | Carter et al. | |
| 6,534,055 B1 | 3/2003 | June et al. | |
| 6,548,640 B1 | 4/2003 | Winter | |
| 6,670,453 B2 | 12/2003 | Frenken et al. | |
| 6,692,964 B1 | 2/2004 | June et al. | |
| 6,759,518 B1 | 7/2004 | Kontermann et al. | |

(Continued)

FOREIGN PATENT DOCUMENTS

| | | |
|---|---|---|
| CN | 1563092 A | 1/2005 |
| CN | 101646689 A | 2/2010 |

(Continued)

OTHER PUBLICATIONS

Zebetakis et al., PLOS One, 2013, 8:e77678 pp. 1-7.*
Harmsen et al., Applied Microbiology Biotechnology, 2007, 22:13-22.*
Almagro et al. Humanization of antibodies. Front Biosci 13:1619-1633 (2008).
Argani et al. Mesothelin is overexpressed in the vast majority of ductal adenocarcinomas of the pancreas: identification of a new pancreatic cancer marker by serial analysis of gene expression (SAGE). Clin Cancer Res 7(12):3862-3868 (2001).

(Continued)

*Primary Examiner* — Hong Sang
(74) *Attorney, Agent, or Firm* — Wilson Sonsini Goodrich & Rosati

(57) ABSTRACT

Provided herein are DLL3 binding proteins and DLL3 targeting multispecific proteins (e.g., DLL3 targeting trispecific protein) comprising a domain binding to CD3, a half-life extension domain, and a domain binding to DLL3 (such as a DLL3 binding protein as provided herein). Also provided are pharmaceutical compositions thereof, as well as nucleic acids, recombinant expression vectors and host cells for making such DLL3 binding proteins, DLL3 targeting trispecific proteins. Also disclosed are methods of using the disclosed DLL3 binding proteins, DLL3 targeting trispecific proteins in the prevention, and/or treatment diseases, conditions and disorders.

16 Claims, 64 Drawing Sheets
Specification includes a Sequence Listing.

(56) References Cited

U.S. PATENT DOCUMENTS

| | | |
|---|---|---|
| 6,767,711 B2 | 7/2004 | Bander |
| 6,797,514 B2 | 9/2004 | Berenson et al. |
| 6,867,041 B2 | 3/2005 | Berenson et al. |
| 6,887,466 B2 | 5/2005 | June et al. |
| 6,905,680 B2 | 6/2005 | June et al. |
| 6,905,681 B1 | 6/2005 | June et al. |
| 6,905,874 B2 | 6/2005 | Berenson et al. |
| 7,067,318 B2 | 6/2006 | June et al. |
| 7,144,575 B2 | 12/2006 | June et al. |
| 7,163,680 B2 | 1/2007 | Bander |
| 7,172,869 B2 | 2/2007 | June et al. |
| 7,175,843 B2 | 2/2007 | June et al. |
| 7,232,566 B2 | 6/2007 | June et al. |
| 7,262,276 B2 | 8/2007 | Huang et al. |
| 7,666,414 B2 | 2/2010 | Bander |
| 7,807,162 B2 | 10/2010 | Silence |
| 7,850,971 B2 | 12/2010 | Maddon et al. |
| 8,114,965 B2 | 2/2012 | Maddon et al. |
| 8,188,223 B2 | 5/2012 | Beirnaert et al. |
| 8,236,308 B2 | 8/2012 | Kischel et al. |
| 8,470,330 B2 | 6/2013 | Schuelke et al. |
| 8,623,356 B2 | 1/2014 | Christopherson et al. |
| 8,629,244 B2 | 1/2014 | Kolkman et al. |
| 8,703,135 B2 | 4/2014 | Beste et al. |
| 8,784,821 B1 | 7/2014 | Kufer et al. |
| 8,846,042 B2 | 9/2014 | Zhou |
| 8,907,071 B2 | 12/2014 | Sullivan et al. |
| 8,937,164 B2 | 1/2015 | Descamps et al. |
| 9,169,316 B2 | 10/2015 | Baty et al. |
| 9,309,327 B2 | 4/2016 | Humphreys et al. |
| 9,327,022 B2 | 5/2016 | Zhang et al. |
| 9,340,621 B2 | 5/2016 | Kufer et al. |
| 9,708,412 B2 | 7/2017 | Baeuerle et al. |
| 9,920,115 B2 | 3/2018 | Dubridge et al. |
| 10,066,016 B2 | 9/2018 | Dubridge et al. |
| 10,100,106 B2 | 10/2018 | Dubridge et al. |
| 2005/0042664 A1 | 2/2005 | Wu et al. |
| 2005/0048617 A1 | 3/2005 | Wu et al. |
| 2005/0100543 A1 | 5/2005 | Hansen et al. |
| 2005/0175606 A1 | 8/2005 | Huang et al. |
| 2006/0046971 A1 | 3/2006 | Stuhler et al. |
| 2006/0121005 A1 | 6/2006 | Berenson et al. |
| 2006/0228364 A1 | 10/2006 | Dennis et al. |
| 2006/0252096 A1 | 11/2006 | Zha et al. |
| 2007/0014794 A1 | 1/2007 | Carter et al. |
| 2007/0178082 A1 | 8/2007 | Silence et al. |
| 2007/0269422 A1 | 11/2007 | Beirnaert et al. |
| 2008/0069772 A1 | 3/2008 | Stuhler et al. |
| 2008/0260757 A1 | 10/2008 | Holt et al. |
| 2009/0028880 A1 | 1/2009 | Beirnaert et al. |
| 2009/0252683 A1 | 10/2009 | Kischel et al. |
| 2009/0259026 A1 | 10/2009 | Tomlinson et al. |
| 2010/0122358 A1 | 5/2010 | Brueggemann et al. |
| 2010/0150918 A1 | 6/2010 | Kufer et al. |
| 2010/0189727 A1 | 7/2010 | Rodeck et al. |
| 2010/0266531 A1 | 10/2010 | Hsieh et al. |
| 2010/0291112 A1 | 11/2010 | Kellner et al. |
| 2011/0129458 A1 | 6/2011 | Dolk et al. |
| 2011/0165621 A1 | 7/2011 | Dreier et al. |
| 2011/0262439 A1 | 10/2011 | Kufer et al. |
| 2011/0275787 A1 | 11/2011 | Kufer et al. |
| 2011/0313135 A1 | 12/2011 | Vanhove et al. |
| 2012/0231024 A1 | 9/2012 | Elsaesser-Beile et al. |
| 2012/0328619 A1 | 12/2012 | Fey et al. |
| 2013/0017200 A1 | 1/2013 | Scheer et al. |
| 2013/0266568 A1 | 10/2013 | Brinkmann et al. |
| 2013/0267686 A1 | 10/2013 | Brinkmann et al. |
| 2013/0273055 A1 | 10/2013 | Borges et al. |
| 2013/0330335 A1 | 12/2013 | Bremel et al. |
| 2014/0004121 A1 | 1/2014 | Fanslow, III et al. |
| 2014/0023664 A1 | 1/2014 | Lowman et al. |
| 2014/0045195 A1 | 2/2014 | Daugherty et al. |
| 2014/0073767 A1 | 3/2014 | Lee et al. |
| 2014/0088295 A1 | 3/2014 | Smith et al. |
| 2014/0302037 A1 | 10/2014 | Borges et al. |
| 2014/0322218 A1 | 10/2014 | Xiao et al. |
| 2015/0037334 A1 | 2/2015 | Kufer et al. |
| 2015/0056206 A1 | 2/2015 | Zhou |
| 2015/0064169 A1 | 3/2015 | Wang et al. |
| 2015/0079088 A1 | 3/2015 | Lowman et al. |
| 2015/0079093 A1 | 3/2015 | Stuhler |
| 2015/0093336 A1 | 4/2015 | Van Ginderachter et al. |
| 2015/0174268 A1 | 6/2015 | Li et al. |
| 2015/0183875 A1 | 7/2015 | Cobbold et al. |
| 2015/0232557 A1 | 8/2015 | Tan et al. |
| 2015/0274836 A1 | 10/2015 | Ho et al. |
| 2015/0274844 A1 | 10/2015 | Blankenship et al. |
| 2016/0024174 A1 | 1/2016 | Odunsi et al. |
| 2016/0032019 A1 | 2/2016 | Xiao et al. |
| 2016/0039942 A1 | 2/2016 | Cobbold et al. |
| 2016/0068605 A1 | 3/2016 | Nemeth et al. |
| 2016/0130331 A1 | 5/2016 | Stull et al. |
| 2016/0215063 A1 | 7/2016 | Bernett et al. |
| 2016/0251440 A1 | 9/2016 | Roobrouck et al. |
| 2016/0257721 A1 | 9/2016 | Lieber et al. |
| 2016/0319040 A1 | 11/2016 | Dreier et al. |
| 2016/0340444 A1 | 11/2016 | Baeuerle et al. |
| 2016/0355842 A1 | 12/2016 | Parks et al. |
| 2017/0029502 A1 | 2/2017 | Raum et al. |
| 2017/0152316 A1 | 6/2017 | Cobbold et al. |
| 2017/0204164 A1 | 7/2017 | Himmler et al. |
| 2017/0275373 A1 | 9/2017 | Kufer et al. |
| 2017/0298149 A1 | 10/2017 | Baeuerle et al. |
| 2017/0334997 A1 | 11/2017 | Dubridge et al. |
| 2017/0369563 A1 | 12/2017 | Dubridge et al. |
| 2018/0016323 A1 | 1/2018 | Brandenburg et al. |
| 2018/0134789 A1 | 5/2018 | Baeuerle et al. |
| 2018/0148508 A1 | 5/2018 | Wang et al. |
| 2018/0161428 A1 | 6/2018 | Dubridge et al. |
| 2018/0162949 A1 | 6/2018 | Baeuerle et al. |
| 2018/0326060 A1 | 11/2018 | Wesche et al. |
| 2018/0327508 A1 | 11/2018 | Wesche et al. |
| 2019/0031749 A1 | 1/2019 | Dubridge et al. |
| 2019/0112381 A1 | 4/2019 | Wesche et al. |
| 2019/0135930 A1 | 5/2019 | Wesche et al. |
| 2019/0225702 A1 | 7/2019 | Baeuerle et al. |

FOREIGN PATENT DOCUMENTS

| | | |
|---|---|---|
| EP | 0239400 A2 | 9/1987 |
| EP | 0519596 A1 | 12/1992 |
| EP | 0592106 A1 | 4/1994 |
| EP | 1378520 A1 | 1/2004 |
| EP | 1736484 A1 | 12/2006 |
| EP | 2336179 A1 | 6/2011 |
| FR | 901228 A | 7/1945 |
| JP | 2005501517 A | 1/2005 |
| WO | WO-9109967 A1 | 7/1991 |
| WO | WO-9307105 A1 | 4/1993 |
| WO | WO-9404678 A1 | 3/1994 |
| WO | WO-9937681 A2 | 7/1999 |
| WO | WO-0043507 A1 | 7/2000 |
| WO | WO-0190190 A2 | 11/2001 |
| WO | WO-0196584 A2 | 12/2001 |
| WO | WO-02085945 A2 | 10/2002 |
| WO | WO-03025020 A1 | 3/2003 |
| WO | WO-03035694 A2 | 5/2003 |
| WO | WO-03064606 A2 | 8/2003 |
| WO | WO-2004003019 A2 | 1/2004 |
| WO | WO-2004041867 A2 | 5/2004 |
| WO | WO-2004042404 A1 | 5/2004 |
| WO | WO-2004049794 A2 | 6/2004 |
| WO | WO-2006020258 A2 | 2/2006 |
| WO | WO-2006122787 A1 | 11/2006 |
| WO | WO-2007024715 A2 | 3/2007 |
| WO | WO-2007042261 A2 | 4/2007 |
| WO | WO-2007062466 A1 | 6/2007 |
| WO | WO-2007115230 A2 | 10/2007 |
| WO | WO-2008028977 A2 | 3/2008 |
| WO | WO-2009025846 A2 | 2/2009 |
| WO | WO-2009030285 A1 | 3/2009 |
| WO | WO-2009147248 A2 | 12/2009 |
| WO | WO-2010003118 A1 | 1/2010 |
| WO | WO-2010037836 A2 | 4/2010 |

(56) References Cited

FOREIGN PATENT DOCUMENTS

| | | |
|---|---|---|
| WO | WO-2010037837 A2 | 4/2010 |
| WO | WO-2011039368 A2 | 4/2011 |
| WO | WO-2011051327 A2 | 5/2011 |
| WO | WO-2012131053 A1 | 10/2012 |
| WO | WO-2012138475 A1 | 10/2012 |
| WO | WO-2012158818 A2 | 11/2012 |
| WO | WO-2013036130 A1 | 3/2013 |
| WO | WO-2013104804 A2 | 7/2013 |
| WO | WO-2013110531 A1 | 8/2013 |
| WO | WO-2013128027 A1 | 9/2013 |
| WO | WO-2014033304 A2 | 3/2014 |
| WO | WO-2014138306 A1 | 9/2014 |
| WO | WO-2014140358 A1 | 9/2014 |
| WO | WO-2014151910 A1 | 9/2014 |
| WO | WO-2015103072 A1 | 7/2015 |
| WO | WO-2015150447 A1 | 10/2015 |
| WO | WO-2015184207 A1 | 12/2015 |
| WO | WO-2016009029 A1 | 1/2016 |
| WO | WO-2016034044 A1 | 3/2016 |
| WO | WO-2016046778 A2 | 3/2016 |
| WO | WO-2016055551 A1 | 4/2016 |
| WO | WO-2016105450 A2 | 6/2016 |
| WO | WO-2016130819 A2 | 8/2016 |
| WO | WO-2016171999 A2 | 10/2016 |
| WO | WO-2016179003 A1 | 11/2016 |
| WO | WO-2016187101 A2 | 11/2016 |
| WO | WO-2016187594 A1 | 11/2016 |
| WO | WO-2016210447 A1 | 12/2016 |
| WO | WO-2017025698 A1 | 2/2017 |
| WO | WO-2017027392 A1 | 2/2017 |
| WO | WO-2017041749 A1 | 3/2017 |
| WO | WO-2017079528 A1 | 5/2017 |
| WO | WO-2017136549 A1 | 8/2017 |
| WO | WO-2017156178 A1 | 9/2017 |
| WO | WO-2018071777 A1 | 4/2018 |
| WO | WO-2018098354 A1 | 5/2018 |
| WO | WO-2018098356 A1 | 5/2018 |
| WO | WO-2018136725 A1 | 7/2018 |
| WO | WO-2018160671 A1 | 9/2018 |
| WO | WO-2018160754 A2 | 9/2018 |
| WO | WO-2018204717 A1 | 11/2018 |
| WO | WO-2018209298 A1 | 11/2018 |
| WO | WO-2018209304 A1 | 11/2018 |
| WO | WO-2019075359 A1 | 4/2019 |
| WO | WO-2019075378 A1 | 4/2019 |
| WO | WO-2019222278 A1 | 11/2019 |
| WO | WO-2019222282 A1 | 11/2019 |
| WO | WO-2019222283 A1 | 11/2019 |

OTHER PUBLICATIONS

Austin et al. Cancer Research (Jul. 2018) vol. 78, No. 13, Supp. Supplement 1. Abstract No. 1781. Meeting Info: 2018 Annual Meeting of the American Association for Cancer Research, AACR 2018. Chicago, IL, United States. Apr. 14, 2018-Apr. 18, 2018).

Baca et al. Antibody humanization using monovalent phage display. J Biol Chem 272(16):10678-10684 (1997).

Baeuerle et al. Bispecific T-cell engaging antibodies for cancer therapy. Cancer Res 69:4941-4944 (2009).

Bedouelle et al. Diversity and junction residues as hotspots of binding energy in an antibody neutralizing the dengue virus. FEBS J 273(1):34-46 (2006).

Bortoletto et al. Optimizing anti-CD3 affinity for effective T cell targeting against tumor cells. Eur J Immunol 32:3102-3107 (2002).

Bracci et al. Cyclophosphamide enhances the antitumor efficacy of adoptively transferred immune cells through the induction of cytokine expression, B-cell and T-cell homeostatic proliferation, and specific tumor infiltration. Clin Cancer Res 13(2 Pt 1):644-653 (2007).

Brown et al. Tolerance of single, but not multiple, amino acid replacements in antibody VH CDR 2: a means of minimizing B cell wastage from somatic hypermutation? J Immunol 156(9):3285-3291 (1996).

Caldas et al. Humanization of the anti-CD18 antibody 6.7: an unexpected effect of a framework residue in binding to antigen. Mol Immunol. 39(15):941-952 (2003).

Carter et al. Humanization of an anti-p185HER2 antibody for human cancer therapy. PNAS USA 89(10):4285-4289 (1992).

Casset et al. A peptide mimetic of an anti-CD4 monoclonal antibody by rational design. Biochemical and Biophysical Research Communication 307:198-205 (2003).

Chang et al. Loop-sequence features and stability determinants in antibody variable domains by high-throughput experiments. Structure 22(1):9-21 (2014).

Chang et al. Molecular cloning of mesothelin, a differentiation antigen present on mesothelium, mesotheliomas, and ovarian cancers. PNAS USA 93:136-140 (1996).

Chatalic et al. A Novel 111 In-labeled Anti-PSMA Nanobody for Targeted SPECT/CT Imaging of Prostate Cancer. J Nucl Med 56(7):1094-1099 and Supplemental Data (2015).

Chen et al. Selection and analysis of an optimized anti-VEGF antibody: Crystal structure of an affinity-matured Fab in complex with antigen. J Mol Bio 293:865-881 (1999).

Chen, Xiaoying et al. Fusion protein linkers: Property, design and functionality. Advanced Drug Delivery Reviews 65:1357-1369 (2013).

Chien et al. Significant structural and functional change of an antigen-binding site by a distant amino acid substitution: proposal of a structural mechanism. PNAS USA 86(14):5532-5536 (1989).

Cho et al. Targeting B Cell Maturation Antigen (BCMA) in Multiple Myeloma: Potential Uses of BCMA-Based Immunotherapy. Front Immunol 9:1821 (2018).

Choi et al. Engineering of Immunoglobulin Fc heterodimers using yeast surface-displayed combinatorial Fc library screening. PLOS One 10(12):e0145349 (2015).

Chothia et al. Canonical structures for the hypervariable regions of immunoglobulins. J Mol Biol 196(4):901-917 (1987).

Chothia, et al. Conformations of immunoglobulin hypervariable regions. Nature. Dec. 21-28, 1989;342(6252):877-83.

Corso et al. Real-time detection of mesothelin in pancreatic cancer cell line supernatant using an acoustic wave immunosensor. Cancer Detect Prev 30:180-187 (2006).

Creaney et al. Detection of malignant mesothelioma in asbestos-exposed individuals: the potential role of soluble mesothelin-related protein. Hematol. Oncol. Clin. North Am. 19:1025-1040 (2005).

Cristaudo et al. Clinical significance of serum mesothelin in patients with mesothelioma and lung cancer. Clin. Cancer Res. 13:5076-5081 (2007).

De Pascalis et al. Grafting of "abbreviated" complementarity-determining regions containing specificity-determining residues essential for ligand contact to engineer a less immunogenic humanized monoclonal antibody. J Immunol. 169(6):3076-3084 (2002).

Dennis et al. Imaging Tumors with an Albumin-Binding Fab, a Novel Tumor-Targeting Agent. Cancer Res 67(1):254-61 (2007).

Document D28—Investigation of human CD3ε variants binding to monoclonal antibodies. Submitted by Pfizer to the European Patent Register on Apr. 30, 2014 in connection with their opposition to the EP2155783 patent. (3 pages) (2014).

Document D78—CD3ε N-terminal peptide bound to the CDRs of SP24. Submitted by Janssen Biotech to the European Patent Register on Mar. 18, 2016 in connection with their opposition to the EP2155783 patent (1 page) (2016).

Document D79—Interactions between CD3ε and SP34 CDR residues. CD3ε residues are in ellipses, SP34 CDR residues are in boxes. Submitted by Janssen Biotech to the European Patent Register on Mar. 18, 2016 in connection with their opposition to the EP2155783 patent (1 page) (2016).

Document D83—Alignment of variable domains from the prior art and the patent. Submitted by Janssen Biotech to the European Patent Register on Mar. 18, 2016 in connection with their opposition to the EP2155783 patent (1 page) (2016).

Foote et al. Antibody Framework Residues Affecting the Conformation of the Hypervariable Loops. J. Mol. Biol. 224(2):487-99 (1992).

Frankel et al. Targeting T cells to tumor cells using bispecific antibodies. Curr Opin Chem Biol 17(3):385-392 (2013).

Giusti et al. Somatic diversification of S107 from an antiphosphocholine to an anti-DNA autoantibody is due to a single base change in its heavy chain variable region. PNAS USA 84(9):2926-30 (1987).

(56) References Cited

OTHER PUBLICATIONS

Goldman et al. Enhancing Stability of Camelid and Shark Single Domain Antibodies: An Overview. Front. Immunol. 8:865 (2017).
Goodman et al. The Pharmaceutical Basis of Therapeutics. 6th ed. pp. 21-25 (1980).
Goswami et al. Developments and Challenges for mAb-Based Therapeutics. Antibodies 2:452-500 (2013).
Gross et al. Endowing T cells with antibody specificity using chimeric T cell receptors. FASEB J. 6(15):3370-3378 (1992).
Gubbels et al. Mesothelin-MUC16 binding is a high affinity, N-glycan dependent interaction that facilitates peritoneal metastasis of ovarian tumors. Mol Cancer 5:50 (2006).
Gussow et al. Chapter 5: Humanization of Monoclonal Antibodies. Methods in Enzymology 203:99-121 (1991).
Harding et al. The immunogenicity of humanized and fully human antibodies: residual immunogenicity resides in the CDR regions. MAbs 2(3):256-265 (2010).
Hassan et al. Detection and quantitation of serum mesothelin, a tumor marker for patients with mesothelioma and ovarian cancer. Clin Cancer Res 12:447-453 (2006).
Hassan et al. Mesothelin targeted cancer immunotherapy. Eur J Cancer 44:46-53 (2008).
Hassan et al. Mesothelin: a new target for immunotherapy. Clin Cancer Res 10:3937-3942 (2004).
Hassan et al. Phase I study of SS1P, a recombinant anti-mesothelin immunotoxin given as a bolus I.V. infusion to patients with mesothelin-expressing mesothelioma, ovarian, and pancreatic cancers. Clin Cancer Res 13(17):5144-5149 (2007).
Hassan et al. Preclinical evaluation of MORAb-009, a chimeric antibody targeting tumor-associated mesothelin. Cancer Immun. 7:20 (2007).
Hellstrom et al. Mesothelin variant 1 is released from tumor cells as a diagnostic marker. Cancer Epidemiol Biomarkers Prev 15:1014-1020 (2006).
Hipp et al. A novel BCMA/CD3 bispecific T-cell engager for the treatment of multiple myeloma induces selective lysis in vitro and in vivo. Leukemia 31(8):1743-1751 (2017).
Ho et al. A novel high-affinity human monoclonal antibody to mesothelin. Int J Cancer 128:2020-2030 (2011).
Ho et al. Mesothelin expression in human lung cancer. Clin Cancer Res 13:1571-1575 (2007).
Ho et al. Mesothelin is shed from tumor cells. Cancer Epidemiol Biomarkers Prev 15:1751 (2006).
Holm et al. Functional mapping and single chain construction of the anti-cytokeratin 8 monoclonal antibody TS1. Mol Immunol 44(6):1075-1084 (2007).
Holt et al. Anti-serum albumin domain antibodies for extending the half-lives of short lived drugs. Protien Eng Des Sel 21(5):283-288 (2008).
Hopp et al. The effects of affinity and valency of an albumin-binding domain (ABD) on the half-life of a single-chain diabody-ABD fusion protein. Protein Eng. Des. Sel. 23(11):827-34 (2010).
Hutchinson et al. Mutagenesis at a specific position in a DNA sequence. J Biol Chem 253:6551-6560 (1978).
Janssen letter—Submission under Rule 116 EPC. Submitted by Janssen Biotech to the European Patent Register on Mar. 18, 2016 in connection with their opposition to the EP2155783 patent (6 pages) (2016).
Kabat et al. Identical V region amino acid sequences and segments of sequences in antibodies of different specificities. Relative contributions of VH and VL genes, minigenes, and complementarity-determining regions to binding of antibody-combining sites. J Immunol 147:1709-1719 (1991).
Kabat et al. Sequences of proteins of immunological interest. NIH Publ. No. 91-3242 1:647-669 (1991).
Kojima et al. Molecular cloning and expression of megakaryocyte potentiating factor cDNA. J Biol Chem 270:21984-21990 (1995).
Laabi et al. The BCMA gene, preferentially expressed during B lymphoid maturation, is bidirectionally transcribed. Nucleic Acids Res 22(7):1147-1154 (1994).

Le Gall et al. Immunosuppressive properties of anti-CD3 single-chain Fv and diabody. J Immunol Methods 285(1):111-127 (2004).
Li et al. Development of novel tetravalent anti-CD20 antibodies with potent antitumor activity. Cancer Res 68:2400-2408 (2008).
Liu et al. A New Format of Single Chain Tri-specific Antibody with Diminished Molecular Size Efficiently Induces Ovarian Tumor Cell Killing. Biotechnology Letters 27(22):1821-1827 (2005).
Liu et al. MGD011, a CD19 × CD3 Dual Affinity Re-Targeting Bi-specific Molecule Incorporating Extended Circulating Half-life for the Treatment of B-cell Malignancies. Clin Cancer Res 23(6):1506-1518 (epub 2016) (2017).
Lowman et al. Monovalent phage display: A method for selecting variant proteins from random libraries. Methods 3:205-216 (1991).
Lu et al. In vitro and in vivo antitumor effect of a trivalent bispecific antibody targeting ErbB2 and CD16. Cancer Biol Ther. 7(11):1744-1750 (2008).
Lutterbuese et al. T cell-engaging BiTE antibodies specific for EGFR potently eliminate KRAS- and BRAF-mutated colorectal cancer cells. PNAS 107:12605-12610 (2007).
MacCallum et al. Antibody-antigen interactions: contact analysis and binding site topography. J Mol Biol. 262(5):732-745 (1996).
Mariuzza et al. The structural basis of antigen-antibody recognition. Annu Rev Biophys Biophys Chem 16:139-159 (1987).
Mirsky et al. Antibody-Specific Model of Amino Acid Substitution for Immunological Inferences from Alignments of Antibody Sequences. Mol. Biol. Evol. 32(3):806-819 (2014).
Morea et al. Antibody modeling: implications for engineering and design. Methods 20(3):267-279 (2000).
Moschella et al. Unraveling cancer chemoimmunotherapy mechanisms by gene and protein expression profiling of responses to cyclophosphamide. Cancer Res 71(10):3528-3539 (2011).
Mueller et al. Improved pharmacokinetics of recombinant bispecific antibody molecules by fusion to human serum albumin. J Bio Chem 282(17):12650-12660 (2007).
Müller et al. Improved Pharmacokinetics of Recombinant Bispecific Antibody Molecules by Fusion to Human Serum Albumin. J. Biol. Chem. 282(17):12650-60 (2007).
Muller et al. Improving the pharmacokinetic properties of biologics by fusion to an anti-HSA shark VNAR domain. MAbs 4(6):673-685 (2012).
Muul et al. Persistence and expression of the adenosine deaminase gene for 12 years and immune reaction to gene transfer components: long-term results of the first clinical gene therapy trial. Blood 101(7):2563-2569 (2003).
Muyldermans. Nanobodies: natural single-domain antibodies. Annu Rev Biochem 82:775-797 (2013).
Nazarian et al. Characterization of bispecific T-cell Engager (BiTE) antibodies with a high-capacity T-cell dependent cellular cytotoxicity (TDCC) assay. J Biomol Screen 20:519-527 (2015).
Nelson et al. Antibody fragments Hope and Hype. mAbs 2(1):77-83 (2010).
Nunez-Prado et al. The coming of age of engineered multivalent antibodies. Drug Discovery Today 20(5):588-594 (2015).
Ohiro et al. A homogeneous and noncompetitive immunoassay based on the enhanced fluorescence resonance energy transfer by leucine zipper interaction. Anal Chem 74(22):5786-5792 (2002).
O'Keefe et al. Chapter 18: Prostate specific membrane antigen. In: Chung L.W.K., Isaacs W.B., Simons J.W. (eds) Prostate Cancer. Contemporary Cancer Research. Humana Press, Totowa, NJ (pp. 307-326) (2001).
Ordonez. Application of mesothelin immunostaining in tumor diagnosis. Am J Surg Pathol 27:1418-1428 (2003).
Padlan et al. Structure of an antibody-antigen complex: Crystal structure of the HyHEL-10 Fab-lysozyme complex. PNAS USA 86:5938-5942 (1989).
Padlan. Anatomy of the Antibody Molecule. Mol Immunol 31(3):169-217 (1994).
Pawluczkowycz et al. Binding of submaximal C1q promotes complement-dependent cytotoxicity (CDC) of B cells opsonized with anti-CD20 mAbs ofatumumab (OFA) or rituximab (RTX): considerably higher levels of CDC are induced by OFA than by RTX. J Immunol 183:749-758 (2009).

(56) References Cited

OTHER PUBLICATIONS

PCT/US2016/033644 International Preliminary Report on Patentability dated Nov. 30, 2017.
PCT/US2016/033644 International Search Report and Written Opinion dated Sep. 6, 2016.
PCT/US2017/033665 International Search Report and Written Opinion dated Oct. 18, 2017.
PCT/US2017/033673 International Search Report and Written Opinion dated Oct. 18, 2017.
PCT/US2017/056530 International Preliminary Report on Patentability dated Apr. 25, 2019.
PCT/US2017/063121 International Search Report and Written Opinion dated Mar. 26, 2018.
PCT/US2017/063121 Invitation to Pay Additional Fees dated Feb. 1, 2018.
PCT/US2017/063126 International Search Report and Written Opinion dated Apr. 5, 2018.
PCT/US2017/063126 Invitation to Pay Additional Fees dated Feb. 1, 2018.
PCT/US2017056530 International Search Report and Written Opinion dated Jan. 23, 2018.
PCT/US2018/014396 International Preliminary Report on Patentability dated Aug. 1, 2019.
PCT/US2018/014396 International Search Report and Written Opinion dated Jun. 14, 2018.
PCT/US2018/020185 International Search Report and Written Opinion dated Jun. 15, 2018.
PCT/US2018/020307 International Search Report and Written Opinion dated Aug. 24, 2018.
PCT/US2018/030983 International Search Report and Written Opinion dated Sep. 25, 2018.
PCT/US2018/030983 Invitation to Pay Additional Fees dated Jul. 31, 2018.
PCT/US2018/032418 International Search Report and Written Opinion dated Sep. 24, 2018.
PCT/US2018/032427 International Search Report and Written Opinion dated Sep. 13, 2018.
PCT/US2018/055659 International Search Report and Written Opinion dated Feb. 21, 2019.
PCT/US2018/055659 Invitation to Pay Additional Fees dated Dec. 19, 2018.
PCT/US2018/055682 International Search Report and Written Opinion dated Mar. 1, 2019.
PCT/US2018/055682 Invitation to Pay Additional Fees dated Jan. 8, 2019.
PCT/US2018/32418 Invitation to Pay Additional Fees dated Jul. 23, 2018.
PCT/US2018/32427 Invitation to Pay Additional Fees dated Jul. 24, 2018.
PCT/US2019/032224 International Search Report and Written Opinion dated Aug. 28, 2019.
PCT/US2019/032302 International Search Report and Written Opinion dated Aug. 22, 2019.
PCT/US2019/032306 International Search Report and Written Opinion dated Aug. 22, 2019.
PCT/US2019/032307 International Search Report and Written Opinion dated Aug. 22, 2019.
Pfizer letter—Opposition to European Patent EP2155783 (Application 08735001.3). Submitted by Pfizer to the European Patent Register on Apr. 30, 2014 in connection with their opposition to the EP2155783 patent. (pp. 1-23 and Appendix 1 on pp. 24-26) (2014).
Presta et al. Humanization of an antibody directed against IgE. J Immunol 151:2623-2632 (1993).
Ramadoss et al. An Anti-B Cell Maturation Antigen bispecific Antibody for Multiple Myeloma. J. Ann. Chem. Soc. 137(16):5288-91 (2015).
Riechmann et al. Single domain antibodies: comparison of camel VH and camelised human VH domains. J Immunol Methods 231(1-2):25-38 (1999).
Rosok et al. A Combinatorial Library Strategy for the Rapid Humanization of Anticarcinoma BR96 Fab. J Biol Chem 271:22611-22618 (1996).
Rozan et al. Single-domain antibody-based and linker-free bispecific antibodies targeting FcγRIII induce potent antitumor activity without recruiting regulatory T cells. Mol Cancer Ther 12(8):1481-1491 (2013).
Rudikoff et al. Single amino acid substitution altering antigen-binding Specificity. PNAS USA 79:1979-1983 (1982).
Rump et al. Binding of ovarian cancer antigen CA125/MUC16 to mesothelin mediates cell adhesion. J Biol Chem 279:9190-9198 (2004).
Running Deer et al. High-level expression of proteins in mammalian cells using transcription regulatory sequences from the Chinese hamster EF-1alpha gene. Biotechnol Prog. 20:880-889 (2004).
Sadelain et al. Targeting tumours with genetically enhanced T lymphocytes. Nat Rev Cancer 3(1):35-45 (2003).
Saerens et al. Identification of a universal VHH framework to graft non-canonical antigen-binding loops of camel single-domain antibodies. J. Mol. Biol. 352(3):597-607 (2005).
Schmidt et al. Cloning and Characterization of Canine Prostate-Specific Membrane Antigen. The Prostate 73:642-650 (2013).
Schmittgen et al. Expression of prostate specific membrane antigen and three alternatively spliced variants of PSMA in prostate cancer patients. Int J Cancer 107:323-329 (2003).
Sims et al. A humanized CD18 antibody can block function without cell destruction. J Immunol., 151 (1993): 2296-2308.
Smirnova et al. Identification of new splice variants of the genes BAFF and BCMA. Mol. Immunol. 45 (4):1179-83 (2008).
Spiess et al. Alternative molecular formats and therapeutic applications for bispecific antibodies. Mol. Immunol. 67(2 Pt A):95-106 (2015).
Sternjak et al. Cancer Research, (Jul. 2017) vol. 77, No. 13, Supp. Supplement 1. Abstract No. 3630. Meeting Info: American Association for Cancer Research Annual Meeting 2017. Washington, DC, United States. Apr. 1, 2017-Apr. 5, 2017.
Stork et al. A novel tri-functional antibody fusion protein with improved pharmacokinetic properties generated by fusing a bispecific single-chain diabody with an albumin-binding domain from streptococcal protein G. Protein Eng. Des. Sel. 20(11):569-76 (2007).
Strop. Veracity of microbial transglutaminase. Bioconjugate Chem. 25(5):855-862 (2014).
Su et al. PSMA specific single chain antibody-mediated targeted knockdown of Notch1 inhibits human prostate cancer cell proliferation and tumor growth. Cancer Lett. 338 (2): 282-291 (2013).
Tang et al. A human single-domain antibody elicits potent antitumor activity by targeting an epitope in mesothelin close to the cancer cell surface. Mol. Cancer Thera 12(4):416-426 (2013).
Thomas et al. Mesothelin-specific CD8(+) T cell responses provide evidence of in vivo cross-priming by antigen-presenting cells in vaccinated pancreatic cancer patients. J Exp Med 200:297-306 (2004).
Tijink et al. Improved tumor targeting of anti-epidermal growth factor receptor nanobodies through albumin binding: taking advantage of modular Nanobody technology. Mol. Cancer Ther. 7(8):2288-97 (2008).
Tiller et al. Facile Affinity Maturation of Antibody Variable Domains Using Natural Diversity Mutagenesis. Front. Immunol. 8:986 (2017).
Tutt et al. Trispecific F(ab')3 derivatives that use cooperative signaling via the TCR/CD3 complex and CD2 to activate and redirect resting cytotoxic T cells. J Immunol. 147(1):60-69 (Jul. 1, 1991).
U.S. Appl. No. 15/160,984 Office Action dated Feb. 24, 2017.
U.S. Appl. No. 15/160,984 Office Action dated Sep. 22, 2016.
U.S. Appl. No. 15/600,264 Office Action dated Apr. 25, 2019.
U.S. Appl. No. 15/600,264 Office Action dated Apr. 26, 2018.
U.S. Appl. No. 15/600,264 Office Action dated Nov. 27, 2018.
U.S. Appl. No. 15/600,264 Office Action dated Oct. 3, 2017.
U.S. Appl. No. 15/600,582 Office Action dated Nov. 16, 2017.
U.S. Appl. No. 15/704,620 Office Action dated Oct. 26, 2017.
U.S. Appl. No. 15/821,498 Office Action dated May 3, 2019.
U.S. Appl. No. 15/821,498 Office Action dated Oct. 26, 2018.
U.S. Appl. No. 15/821,530 Office Action dated Apr. 3, 2019.

(56) References Cited

OTHER PUBLICATIONS

U.S. Appl. No. 15/821,530 Office Action dated Sep. 25, 2018.
U.S. Appl. No. 15/977,968 Office Action dated Feb. 21, 2019.
U.S. Appl. No. 15/977,988 Office Action dated Aug. 20, 2019.
U.S. Appl. No. 15/977,988 Office Action dated Mar. 26, 2019.
U.S. Appl. No. 15/977,988 Preinterview First Office Action dated Jan. 25, 2019.
U.S. Appl. No. 16/159,545 Office Action dated Aug. 6, 2019.
U.S. Appl. No. 16/159,554 Office Action dated Jun. 7, 2019.
U.S. Appl. No. 16/159,554 Office Action dated Oct. 1, 2019.
Vajdos et al. Comprehensive functional maps of the antigen-binding site of an anti-ErbB2 antibody obtained with shotgun scanning mutagenesis. J Mol Biol 320:415-428 (2002).
Van Den Beuchken et al. Building novel binding ligands to B7.1 and B7.2 based on human antibody single variable light chain domains. J Mol biol 310:591-601 (2001).
Van Der Linden et al. Induction of immune responses and molecular cloning of the heavy chain antibody repertoire of Lama glama. J Immunol Methods 240:185-195 (2000).
Vaughan et al. Human antibodies by design. Nature Biotech 16:535-539 (1998).
Vincke et al. General strategy to humanize a camelid single-domain antibody and identification of a universal humanized nanobody scaffold. J. Biol. Chem. 284(5):3273-3284 (2009).
Wang et al. A New Recombinant Single Chain Trispecific Antibody Recruits T Lymphocytes to Kill CEA (Carcinoma Embryonic Antigen) Positive Tumor Cells In Vitro Efficiently. Journal of Biochemistry 135(4):555-565 (2004).
Winkler et al. Changing the antigen binding specificity by single point mutations of an anti-p24 (HIV-1) antibody. J Immunol. 165(8):4505-4514 (2000).
Wu et al. Humanization of a murine monoclonal antibody by simultaneous optimization of framework and CDR residues. J.Mol. Biol. 294:151-162 (1999).
Yee et al. Adoptive T cell therapy using antigen-specific CD8+ T cell clones for the treatment of patients with metastatic melanoma: in vivo persistence, migration, and antitumor effect of transferred T cells. PNAS USA 99(25):16168-16173 (2002).
Yu et al. Rationalization and design of the complementarity determining region sequences in an antibody-antigen recognition interface. PLoS One 7(3):e33340 (2012).
Zare et al. Production of nanobodies against prostate-specific membrane antigen (PSMA) recognizing LnCaP cells. Int. J. Biol. Markers 29(2):e169-e179 (2014).
Zhu et al. COMBODY: one-domain antibody multimer with improved avidity. Immunology and Cell Biology 88(6):667-675 (2010).
Agata et al. Expression of the PD-1 antigen on the surface of stimulated mouse T and B lymphocytes. Int. Immunol 8:765-75 (1996).
Al-Lazikani et al. Standard conformations for the canonical structures of immunoglobulins. J. Mol Biology 273(4):927-948 (1997).
Altschul et al. Basic local alignment search tool. J Mol Biol 215(3):403-410 (1990).
Altschul, et al. Gapped BLAST and PSI-BLAST: a new generation of protein database search programs. Nucleic Acids Res 25:3389-3402 (1977).
Barrett et al. Treatment of advanced leukemia in mice with mRNA engineered T cells. Hum Gene Ther 22:1575-1586 (2011).
Batzer et al. Enhanced evolutionary PCR using oligonucleotides with inosine at the 3'-terminus. Nucleic Acids Res. 19(18):5081 (1991).
Bird et al. Single-chain antigen-binding proteins. Science 242(4877):423-426 (1988).
Blank et al. Interaction of PD-L1 on tumor cells with PD-1 on tumor-specific T cells as a mechanism of immune evasion: implications for tumor immunotherapy. Cancer Immunol Immunother 54:307-314 (2005).
Caldas et al. Design and synthesis of germline-based hemi-humanized single-chain Fv against the CD18 surface antigen. Protein Eng 13(5):353-360 (2000).
Carter et al. PD-1: PD-L inhibitory pathway affects both CD4(+) and CD8(+) T cells and is overcome by IL-2. Eur J Immunol 32:634-643 (2002).
Cougot et al. 'Cap-tabolism'. Trends in Biochem Sci 29:436-444 (2001).
Couto et al. Anti-BA46 monoclonal antibody Mc3: humanization using a novel positional consensus and in vivo and in vitro characterization. Cancer Res 55(8):1717-1722 (1995).
Couto et al. Designing human consensus antibodies with minimal positional templates. Cancer Res 55(23 Supp):5973s-5977s (1995).
Dao et al. Targeting the intracellular WT1 oncogene product with a therapeutic human antibody. Sci Transl Med 5(176):176ra33 (2013).
De Genst et al. Antibody repertoire development in camelids. Dev Comp Immunol 30(1-2):187-198 (2006).
Dong et al. B7-H1 pathway and its role in the evasion of tumor immunity. J Mol Med 81:281-287 (2003).
Elango et al. Optimized transfection of mRNA transcribed from a d(A/T)100 tail-containing vector. Biochim Biophys Res Commun 330:958-966 (2005).
Freeman et al. Engagement of the PD-1 immunoinhibitory receptor by a novel B7 family member leads to negative regulation of lymphocyte activation. J Exp Med 192:1027-1034 (2000).
Garland et al. The use of Teflon cell culture bags to expand functionally active CD8+ cytotoxic T lymphocytes. J Immunol Meth 227(1-2):53-63 (1999).
Grupp et al. Chimeric antigen receptor-modified T cells for acute lymphoid leukemia. NEJM 368:1509-1518 (2013).
Haanen et al. Selective expansion of cross-reactive CD8(+) memory T cells by viral variants. J Exp Med 190(9):1319-1328 (1999).
Hollinger et al. "Diabodies": Small bivalent and bispecific antibody fragments. PNAS USA 90:6444 6448 (1993).
Huston et al. Protein engineering of antibody binding sites: recovery of specific activity in an anti-digoxin single-chain Fv analogue produced in *Escherichia coli*. PNAS USA 85(16):5879-5883 (1988).
Izumoto et al. Phase II clinical trial of Wilms tumor 1 peptide vaccination for patients with recurrent glioblastoma multiforme. J Neurosurg 108:963-971 (2008).
Jones et al. Replacing the complementarity-determining regions in a human antibody with those from a mouse. Nature 321:522-525 (1986).
Kalos et al. T cells with chimeric antigen receptors have potent antitumor effects and can establish memory in patients with advanced leukemia. Sci Transl Med 3(95):95ra73 (2011).
Konishi et al. B7-H1 expression on non-small cell lung cancer cells and its relationship with tumor-infiltrating lymphocytes and their PD-1 expression. Clin Cancer Res 10:5094-5100 (2004).
Latchman et al. PD-L2 is a second ligand for PD-1 and inhibits T cell activation. Nat Immunol 2:261-268 (2001).
Milone et al. Chimeric receptors containing CD137 signal transduction domains mediate enhanced survival of T cells and increased antileukemic efficacy in vivo. Mol Ther 17(8):1453-1464 (2009).
Mumtaz et al. Design of liposomes for circumventing the reticuloendothelial cells. Glycobiology 5:505-10 (1991).
Nacheva et al. Preventing nondesired RNA-primed RNA extension catalyzed by T7 RNA polymerase. Eur J Biochem 270:1458-1465 (2003).
Needleman et al. A general method applicable to the search for similarities in the amino acid sequence of two proteins. J. Mol. Biol. 48:443-453 (1970).
Nicholson et al. Construction and characterisation of a functional CD19 specific single chain Fv fragment for immunotherapy of B lineage leukaemia and lymphoma. Mol Immun 34(16-17):1157-1165 (1997).
Nishikawa et al. Nonviral vectors in the new millennium: delivery barriers in gene transfer. Human Gene Therapy. 12:861-870 (2001).
Ohtsuka et al. An alternative approach to deoxyoligonucleotides as hybridization probes by insertion of Deoxyinosine at Ambiguous Codon Positions. J Biol Chem 260(5):2605-2608 (Mar. 10, 1985).
Padlan. A possible procedure for reducing the immunogenicity of antibody variable domains while preserving their ligand-binding properties. Mol Immunol 28(4-5):489-498 (1991).
PCT/US2019/052206 International Search Report and Written Opinion dated Feb. 14, 2020.

(56) References Cited

OTHER PUBLICATIONS

PCT/US2019/052206 Invitation to Pay Additional Fees dated Dec. 23, 2019.
PCT/US2019/052270 Invitation to Pay Additional Fees dated Jan. 9, 2020.
PCT/US2019/053017 International Search Report and Written Opinion dated Jan. 31, 2020.
PCT/US2019/053017 Invitation to Pay Additional Fees dated Nov. 27, 2019.
Pearson, et al. Improved Tools for Biological Sequence Comparison. Proc. Nat'l Acad. Sci. USA. 85 (1988): 2444-48.
Pedersen et al. Comparison of surface accessible residues in human and murine immunoglobulin Fv domains. Implication for humanization of murine antibodies. J Mol Biol 235(3):959-973 (1994).
Porter et al. Chimeric antigen receptor T cells persist and induce sustained remissions in relapsed refractory chronic lymphocytic leukemia. Sci Trans Med 7(303):303ra319 (2015).
Porter et al. Chimeric antigen receptor-modified T cells in chronic lymphoid leukemia. NEJM 365:725-733 (2011).
Presta. Antibody Engineering. Curr Op Struct Biol 2:593-596 (1992).
Riechmann et al. Reshaping human antibodies for therapy. Nature, 332.6162:323-7 (1988).
Roguska et al. A comparison of two murine monoclonal antibodies humanized by CDR-grafting and variable domain resurfacing. Protein Eng 9(10):895-904 (1996).
Roguska et al. Humanization of murine monoclonal antibodies through variable domain resurfacing. PNAS 91:969-973 (1994).
Rosenberg et al. Use of tumor-infiltrating lymphocytes and interleukin-2 in the immunotherapy of patients with metastatic melanoma. A preliminary report. NEJM 319:1676 (1988).
Rossolini et al. Use of deoxyinosine-containing primers vs degenerate primers for polymerase chain reaction based on ambiguous sequence information. Mol Cell Probes 8(2):91-98 (1994).
Sadelain et al. The basic principles of chimeric antigen receptor design. Cancer Discov. 3(4):388-98 (2013).
Sandhu. A rapid procedure for the humanization of monoclonal antibodies. Gene 150(2):409-410 (1994).
Sastry et al. Targeting hepatitis B virus-infected cells with a T-cell receptor-like antibody. J Virol 85(5):1935-1942 (2011).
Schenborn et al. A novel transcription property of SP6 and T7 RNA polymerases: dependence on template structure. Nuc Acids Res 13:6223-6236 (1985).
Scheraga. Predicting three-dimensional structures of oligopeptides. Rev Computational Chem 3:73-142 (1992).
Sergeeva et al. An anti-PR1/HLA-A2 T-cell receptor-like antibody mediates complement-dependent cytotoxicity against acute myeloid leukemia progenitor cells. Blood 117(16):4262-4272 (2011).
Smith et al. Comparison of Biosequences. Advances in Applied Mathematics. 2:482-489 (1981).
Song et al. CD27 costimulation augments the survival and antitumor activity of redirected human T cells in vivo. Blood 119(3):696-706 (2012).
Stepinski et al. Synthesis and properties of mRNAs containing the novel 'anti-reverse' cap analogs 7-methyl(3'0-methyl)GpppG and 7-methyl(e'-deoxy)GpppG. RNA 7:1486-1495 (2001).
Studnicka et al. Human-engineered monoclonal antibodies retain full specific binding activity by preserving non-CDR complementarity-modulating residues. Pro Eng 7(6):805-814 (1994).
Tan et al. "Superhumanized" antibodies: reduction of immunogenic potential by complementarity-determining region grafting with human germline sequences: application to an anti-CD28. J Immunol 169:1119-1125 (2002).
Tassev et al. Retargeting NK92 cells using an HLA-A2-restricted, EBNA3C-specific chimeric antigen receptor. Cancer Gene Ther 19(2):84-100 (2012).
Ten Berg et al. Selective expansion of a peripheral blood CD8+ memory T cell subset expressing both granzyme B and L-selectin during primary viral infection in renal allograft recipients. Transplant Proc 30(8):3975-3977 (1998).
Ui-Tei et al. Sensitive assay of RNA interference in *Drosophila* and Chinese hamster cultured cells using firefly luciferase gene as target. FEBS Letters 479: 79-82 (2000).
U.S. Appl. No. 15/630,259 Office Action dated Dec. 30, 2019.
U.S. Appl. No. 16/159,545 Office Action dated Dec. 2, 2019.
Verhoeyen et al. Reshaping human antibodies: Grafting an antilysozyme activity. Science 239:1534-1536 (1988).
Verma et al. TCR mimic monoclonal antibody targets a specific peptide/HLA class I complex and significantly impedes tumor growth in vivo using breast cancer models. J Immunol 184(4):2156-2165 (2010).
Willemsen et al. A phage display selected fab fragment with MHC class I-restricted specificity for MAGE-A1 allows for retargeting of primary human T lymphocytes. Gene Ther 8(21):1601-1608 (2001).
Yan et al. Engineering upper hinge improves stability and effector function of a human IgG1. J. Biol. Chem. 287:5891 (2012).
Yoshinaga et al. Ig L-chain shuffling for affinity maturation of phage library-derived human anti-human MCP-1 antibody blocking its chemotactic activity. J Biochem 143(5):593-601 (2008).

* cited by examiner

DLL3 BINDING PROTEINS AND METHODS OF USE

CROSS-REFERENCE

This application claims the benefit of U.S. Provisional Application Nos. 62/736,368 filed on Sep. 25, 2018; 62/736,358 filed on Sep. 25, 2018; and 62/877,227 filed Jul. 22, 2019 each of which are incorporated by reference herein in their entirety.

SEQUENCE LISTING

The instant application contains a Sequence Listing which has been submitted electronically in ASCII format and is hereby incorporated by reference in its entirety. Said ASCII copy, created on Sep. 25, 2019, is named 47517-733_201_SL.txt and is 951,519 bytes in size.

BACKGROUND OF THE INVENTION

The selective destruction of an individual cell or a specific cell type is often desirable in a variety of clinical settings. For example, it is a primary goal of cancer therapy to specifically destroy tumor cells, while leaving healthy cells and tissues intact and undamaged. One such method is by inducing an immune response against the tumor, to make immune effector cells such as natural killer (NK) cells or cytotoxic T lymphocytes (CTLs) attack and destroy tumor cells.

SUMMARY OF THE INVENTION

There is still a need for having available further options for the treatment of tumorous diseases related to the overexpression of DLL3, such as neuroendocrine tumors. The present disclosure provides, in certain embodiments, single domain proteins which specifically bind to DLL3 on the surface of tumor target cells and multispecific proteins, such as trispecific proteins containing DLL3 binding domain as described herein. In some embodiments, the present disclosure provides Delta Like Ligand 3 (DLL3) binding proteins, or multispecific proteins as mentioned above, which can be used for diagnosing and treating indications correlated to the expression of DLL3.

One embodiment provides a DLL3 targeting trispecific protein, wherein said protein comprises (a) a first domain (A) which is a single chain variable fragment that specifically binds to a human CD3; (b) a second domain (B) which is a single domain antibody that specifically binds to a human serum albumin protein; and (c) a third domain (C) which is a single domain antibody that specifically binds to a DLL3 protein, wherein the third domain (C) comprises a CDR1 that has the amino acid sequence of SEQ ID No. 874, a CDR2 that has the amino acid sequence of SEQ ID No. 1316, and a CDR3 that has the amino acid sequence of SEQ ID No. 1758.

One embodiment provides, a DLL3 targeting trispecific protein, wherein said protein comprises (a) a first domain (A) which is a single chain variable fragment that specifically binds to a human CD3; (b) a second domain (B) which is a single domain antibody that specifically binds to a human serum albumin protein; and (c) a third domain (C) which is a single domain antibody that specifically binds to DLL3, wherein the third domain comprises a CDR1 that has an amino acid sequence selected from the group consisting of SEQ ID Nos. 851, 867, 871, 872, 873, 874, and 1887; a CDR2 that has an amino acid sequence selected from the group consisting of SEQ ID Nos. 1293, 1309, 1313, 1314, 1315, 1316 and 1888; and a CDR3 that has an amino acid sequence selected from the group consisting of SEQ ID Nos. 1735, 1751, 1755, 1756, 1757, 1758, and 1889. In some embodiment, the third domain (C) comprises a sequence that is at least 80% identical to a sequence selected from the group consisting of SEQ ID Nos. 408, 425, 432, 430, 431, and 1886. In some embodiments, the third domain (C) comprises a sequence selected from the group consisting of SEQ ID Nos. 408, 425, 432, 430, 431, and 1886.

In some embodiments, the domains are linked in the order H2N-(A)-(B)-(C)-COOH, H2N-(A)-(C)-(B)-COOH, H2N-(B)-(A)-(C)-COOH, H2N-(B)-(C)-(A)-COOH, H2N-(C)-(B)-(A)-COOH, or H2N-(C)-(A)-(B)-COOH, or by linkers L1 and L2, in the order H2N-(A)-L1-(B)-L2-(C)-COOH, H2N-(A)-L1-(C)-L2-(B)-COOH, H2N-(B)-L1-(A)-L2-(C)-COOH, H2N-(B)-L1-(C)-L2-(A)-COOH, H2N-(C)-L1-(B)-L2-(A)-COOH, or H2N-(C)-L1-(A)-L2-(B)-COOH.

In some embodiments, the domains are linked in the order H2N-(A)-(B)-(C)-COOH or by linkers L1 and L2 in the order of H2N-(A)-L1-(B)-L2-(C)-COOH. In some embodiments, the domains are linked in the order H2N-(C)-(B)-(A)-COOH or by linkers L1 and L2 in the order of H2N-(C)-L1-(B)-L2-(A)-COOH. In some embodiments, the third domain (C) is an affinity matured binding molecule derived from a parental molecule that specifically binds to the DLL3 protein.

In some embodiments, the affinity matured binding DLL3 binding molecule has a binding affinity toward the DLL3 protein that is about 2-fold about 50-fold greater than the binding affinity of the parental molecule toward the DLL3 protein. In some embodiments, the parental molecule comprises the amino acid sequence of SEQ ID No. 68 or SEQ ID No. 75.

In some embodiments, the linkers L1 and L2 are each independently selected from the group consisting of $(GS)_n$ (SEQ ID No.1809), $(GGS)_n$ (SEQ ID No.1810), $(GGGS)_n$ (SEQ ID No.1811), $(GGSG)_n$ (SEQ ID No.1812), $(GGSGG)_n$ (SEQ ID No.1813), or $(GGGGS)_n$ (SEQ ID No.1814), wherein n is 1, 2, 3, 4, 5, 6, 7, 8, 9, or 10. In some embodiments, the linkers L1 and L2 independently comprises the sequence of GGGGSGGGS (SEQ ID No. 1808).

In some embodiments, the second domain (B) comprises an amino acid sequence selected from the group consisting of SEQ ID Nos. 1769-1778. In some embodiments, the first domain (A) comprises an amino acid sequence selected from the group consisting of SEQ ID Nos. 1793-1802 and 1897-1898. In some embodiments, the DLL3 targeting trispecific protein comprises the sequence of SEQ ID No. 1890 or SEQ ID No. 1891. In some embodiments, the third domain (C) binds to a human DLL3 protein comprising the sequence of SEQ ID No. 1893.

One embodiment provides a DLL3 binding protein comprising a CDR1 that has the amino acid sequence of SEQ ID No. 874, a CDR2 that has the amino acid sequence of SEQ ID No. 1316, and a CDR3 that has the amino acid sequence of SEQ ID No. 1758. In some embodiments, the DLL3 binding protein comprises a sequence that is at least 80% identical to the amino acid sequence of SEQ ID No. 432.

One embodiment provides a DLL3 binding protein comprising a CDR1 that has an amino acid sequence selected from the group consisting of SEQ ID Nos. 851, 867, 871, 872, 873, 874, and 1887; a CDR2 that has an amino acid sequence selected from the group consisting of SEQ ID Nos. 1293, 1309, 1313, 1314, 1315, 1316 and 1888; and a CDR3 that has an amino acid sequence selected from the group consisting of SEQ ID Nos. 1735, 1751, 1755, 1756, 1757, 1758, and 1889. In some embodiments, the DLL3 binding protein comprises a sequence that is at least 80% identical to a sequence selected from the group consisting of SEQ ID Nos. 408, 425, 432, 430, 431, and 1886.

One embodiment provides a method of treating or ameliorating a disease, comprising administering an effective amount of a DLL3 targeting trispecific protein according to any one of the above embodiments.

One embodiment provides a DLL3 targeting trispecific protein, wherein said protein comprises
(a) a first domain (A) which is a single chain variable fragment that specifically binds to a human CD3;
(b) a second domain (B) which is a single domain antibody that specifically binds to a human serum albumin protein; and
(c) a third domain (C) which is a single domain antibody that specifically binds to a DLL3 protein, wherein the third domain (C) comprises a sequence that is at least 80% identical to a sequence selected from the group consisting of SEQ ID Nos. 1-442 and 1886.

In some embodiments, the domains are linked in the order H2N-(A)-(B)-(C)-COOH, H2N-(A)-(C)-(B)-COOH, H2N-(B)-(A)-(C)-COOH, H2N-(B)-(C)-(A)-COOH, H2N-(C)-(B)-(A)-COOH, or H2N-(C)-(A)-(B)-COOH, or by linkers L1 and L2, in the order H2N-(A)-L1-(B)-L2-(C)-COOH, H2N-(A)-L1-(C)-L2-(B)-COOH, H2N-(B)-L1-(A)-L2-(C)-COOH, H2N-(B)-L1-(C)-L2-(A)-COOH, H2N-(C)-L1-(B)-L2-(A)-COOH, or H2N-(C)-L1-(A)-L2-(B)-COOH.

In some embodiments, the third domain (C) is an affinity matured binding molecule derived from a parental molecule that specifically binds to the DLL3 protein. In some embodiments, the affinity matured binding DLL3 binding molecule has a binding affinity toward the DLL3 protein that is about 2-fold about 50-fold greater than the binding affinity of the parental molecule toward the DLL3 protein.

In some embodiments, the third domain (C) comprises a sequence selected from the group consisting of SEQ ID Nos. 1-442 and 1886. In some embodiments, the third domain (C) comprises a sequence that is selected from the group consisting of SEQ ID Nos. 1-52. In some embodiments, the third domain (C) comprises a CDR1, a CDR2, and a CDR3, wherein the CDR1 comprises a sequence selected from the group consisting of SEQ ID Nos. 443-884 and 1887, wherein the CDR2 comprises a sequence selected from the group consisting of SEQ ID Nos. 885-1326 and 1888, and wherein the CDR3 comprises a sequence selected from the group consisting of SEQ ID Nos. 1327-1768 and 1889. In some embodiments, the CDR1 comprises a sequence selected from the group consisting of SEQ ID Nos. 495-528. In some embodiments, the CDR2 comprises a sequence selected from the group consisting of SEQ ID Nos. 937-970. In some embodiments, the CDR3 comprises a sequence selected from the group consisting of SEQ ID Nos. 1379-1412. In some embodiments, the third domain (C) comprises a sequence selected from the group consisting of SEQ ID Nos. 53-86.

In some embodiments, the third domain (C) comprises a CDR1, a CDR2, and a CDR3, and wherein the CDR1 comprises a sequence selected from the group consisting of SEQ ID Nos. 529-809. In some embodiments, the CDR2 comprises a sequence selected from the group consisting of SEQ ID Nos. 971 to 1251. In some embodiments, the CDR3 comprises a sequence selected from the group consisting of SEQ ID Nos. 1379-1412. In some embodiments, the third domain (C) comprises a sequence selected from the group consisting of SEQ ID Nos. 87-367. In some embodiments, the third domain (C) comprises a CDR1, a CDR2, and a CDR3, and wherein the CDR1 comprises a sequence selected from the group consisting of SEQ ID Nos. 810-884. In some embodiments, the CDR2 comprises a sequence selected from the group consisting of SEQ ID Nos. 1252 to 1326. In some embodiments, the CDR3 comprises a sequence selected from the group consisting of SEQ ID Nos. 1692 to 1768. In some embodiments, the third domain (C) comprises a sequence selected from the group consisting of SEQ ID Nos. 368-442. In some embodiments, the first domain (A) comprises a sequence selected from the group consisting of SEQ ID Nos. 1793 to 1807 and 1897-1898.

In some embodiments, the second domain (B) comprises a sequence selected from the group consisting of SEQ ID Nos. 1769-1778. In some embodiments, the linkers L1 and L2 are each independently selected from (GS)$_n$ (SEQ ID No.1809), (GGS)$_n$ (SEQ ID No.1810), (GGGS)$_n$ (SEQ ID No.1811), (GGSG)$_n$ (SEQ ID No.1812), (GGSGG)$_n$ (SEQ ID No.1813), or (GGGGS)$_n$ (SEQ ID No.1814), wherein n is 1, 2, 3, 4, 5, 6, 7, 8, 9, or 10. In some embodiments, the domains are linked in the order H2N-(A)-(B)-(C)-COOH or by linkers L1 and L2 in the order of H2N-(A)-L1-(B)-L2-(C)-COOH. In some embodiments, the linkers L1 and L2 independently comprise the sequence of GGGGSGGGS (SEQ ID No. 1808). In some embodiments, the DLL3 targeting trispecific protein comprises the sequence of SEQ ID No. 1890 or SEQ ID No. 1891.

One embodiment provides a DLL3 targeting trispecific protein, wherein said protein comprises (a) a first domain (A) which is a single chain variable fragment that specifically binds to a human CD3; (b) a second domain (B) which is a single domain antibody that specifically binds to a human serum albumin protein; and (c) a third domain (C) which is a single domain antibody that specifically binds to DLL3, wherein the third domain comprises the sequence of SEQ ID No.68 or SEQ ID No. 75, or is derived from SEQ ID No.68 or SEQ ID No. 75. In some embodiments, the third domain (C) is derived from SEQ ID No. 68 or from SEQ ID No. 75. In some embodiments, the third domain (C) comprises the sequence of SEQ ID No. 68 or the sequence of SEQ ID No. 75.

One embodiment provides a DLL3 binding protein comprising the following formula:

f1-r1-f2-r2-f3-r3-f4 wherein, r1 is a complementarity determining region 1 (CDR1) and is identical to or comprises one or more amino acid residue substitutions relative to a sequence selected from the group consisting of SEQ ID Nos. 443-884 and 1887; r2 is a CDR2 and is identical to or comprises one or more amino acid residue substitutions relative to a sequence selected from the group consisting of SEQ ID Nos. 885-1326 and 1888; and r3 is a CDR3 and identical to or comprises one or more amino acid residue substitutions relative to a sequence selected from the group consisting of SEQ ID Nos. 1327-1768 and 1889; and wherein f1, f2, f3 and f4 are framework residues. In some embodiments, the CDR1 comprises a sequence selected from the group consisting of SEQ ID Nos. 443-884 and 1887, the CDR2 comprises a sequence selected from the group consisting of SEQ ID Nos. 885-1326 and 1888, and the CDR3 comprises a sequence selected from the group consisting of SEQ ID Nos. 1327-1768 and 1889.

One embodiment provides a DLL3 targeting trispecific protein, wherein said protein comprises (a) a first domain (A) which is a single chain variable fragment that specifically binds to a human CD3; (b) a second domain (B) which is a single domain antibody that specifically binds to a human serum albumin protein; and (c) a third domain (C) which is a single domain antibody that specifically binds to a DLL3 protein.

In some embodiments, the domains are linked in the order H2N-(A)-(B)-(C)-COOH, H2N-(A)-(C)-(B)-COOH, H2N-(B)-(A)-(C)-COOH, H2N-(B)-(C)-(A)-COOH, H2N-(C)-(B)-(A)-COOH, or H2N-(C)-(A)-(B)-COOH, or by linkers L1 and L2, in the order H2N-(A)-L1-(B)-L2-(C)-COOH, H2N-(A)-L1-(C)-L2-(B)-COOH, H2N-(B)-L1-(A)-L2-(C)-COOH, H2N-(B)-L1-(C)-L2-(A)-COOH, H2N-(C)-L1-(B)-L2-(A)-COOH, or H2N-(C)-L1-(A)-L2-(B)-COOH.

In some embodiments, the third domain (C) comprises an affinity matured binding molecule. In some embodiments, the affinity matured binding molecule is derived from a parental molecule that specifically binds to the DLL3 protein. In some embodiments, wherein the affinity matured binding DLL3 binding molecule has a binding affinity toward the DLL3 protein that is about 2-fold about 50-fold greater than the binding affinity of the parental molecule toward the DLL3 protein. In some embodiments, the third domain (C) comprises a sequence that is at least 80% identical to a sequence selected from the group consisting of SEQ ID Nos. 1-442 and 1886. In some embodiments, the third domain (C) comprises a sequence that is at least 80% identical to a sequence selected from the group consisting of SEQ ID Nos. 1-52. In some embodiments, the third domain (C) comprises a CDR1, a CDR2, and a CDR3, wherein the CDR1 comprises a sequence selected from the group consisting of SEQ ID Nos. 443-884 and 1887, wherein the CDR2 comprises a sequence selected from the group consisting of SEQ ID Nos. 885-1326 and 1888, and wherein the CDR3 comprises a sequence selected from the group consisting of SEQ ID Nos. 1327-1768 and 1889. In some embodiments, the CDR1 comprises a sequence selected from the group consisting of SEQ ID Nos. 495-528. In some embodiments, the CDR2 comprises a sequence selected from the group consisting of SEQ ID Nos. 937-970. In some embodiments, the CDR3 comprises a sequence selected from the group consisting of SEQ ID Nos. 1379-1412. In some embodiments, the third domain (C) comprises a sequence that is at least 80% identical to a sequence selected from the group consisting of SEQ ID Nos. 53-86. In some embodiments, the CDR1 comprises a sequence selected from the group consisting of SEQ ID Nos. 529-809. In some embodiments, the CDR2 comprises a sequence selected from the group consisting of SEQ ID Nos. 971 to 1251. In some embodiments, the CDR3 comprises a sequence selected from the group consisting of SEQ ID Nos. 1379-1412. In some embodiments, the third domain (C) comprises a sequence that is at least 80% identical to a sequence selected from the group consisting of SEQ ID Nos. 87-367. In some embodiments, the CDR1 comprises a sequence selected from the group consisting of SEQ ID Nos. 810-884. In some embodiments, the CDR2 comprises a sequence selected from the group consisting of SEQ ID Nos. 1252 to 1326. In some embodiments, the CDR3 comprises a sequence selected from the group consisting of SEQ ID Nos. 1692 to 1768. In some embodiments, The DLL3 targeting trispecific protein of claim 1, wherein the third domain (C) comprises a sequence that is at least 80% identical to a sequence selected from the group consisting of SEQ ID Nos. 368-442.

One embodiment provides a DLL3 targeting trispecific protein, wherein said protein comprises (a) a first domain (A) which is a single chain variable fragment that specifically binds to a human CD3; (b) a second domain (B) which is a single domain antibody that specifically binds to a human serum albumin protein; and (c) a third domain (C) which is a single domain antibody that specifically binds to DLL3, wherein the third domain comprises the sequence of SEQ ID No.68 or SEQ ID No. 75, or is derived from SEQ ID No.68 or SEQ ID No. 75.

In some embodiments, the third domain (C) is derived from SEQ ID No. 75. In some embodiments, the third domain comprises a CDR1, a CDR2, and a CDR3, wherein the CDR1 comprises the following sequence: $X_1X_2X_3X_4X_5X_6X_7SX_8A$, the CDR2 comprises the following sequence: $GJ_1SJ_2J_3GJ_4J_5J_6YJ_7J_8SVKG$ (SEQ ID No. 1894), and the CDR3 comprises the following sequence: $Z_1Z_2Z_3Z_4Z_5Z_6Z_7Z_8Z_9$.

In some embodiments:
$X_1$ is A, D, E, F, G, H, K, L, M, N, Q, R, S, V, W, or Y;
$X_2$ is D, E, H, K, M, P, R, S, T, or Y;
$X_3$ is A, D, G, H, K, N, P, Q, R, S, T, V, or Y;
$X_4$ is K, S, or V;
$X_5$ is A, F, G, H, K, L, M, N, Q, R, S, T, V, W, or Y;
$X_6$ is D, F, H, I, K, L, M, N, Q, R, S, V, or Y;
$X_7$ is L, or M; and
$X_8$ is I, L, M, S, T, or V.
In some embodiments:
$J_1$ is I, or V;
$J_2$ is A, D, E, G, H, I, K, L, N, P, Q, R, S, T, V, or Y;
$J_3$ is A, D, E, G, H, N, R, or T;
$J_4$ is H, P, R, or S;
$J_5$ is A, H, I, K, M, N, Q, R, T, or V;
$J_6$ is A, D, G, H, I, L, M, N, S, T, V, or Y;
$J_7$ is A, F, I, L, M, R, S, T, V, or Y;
$J_8$ is A, D, E, G, H, K, L, N, R, S, or V;
In some embodiments:
$Z_1$ is L, or Y;
$Z_2$ is D, E, G, H, K, N, Q, R, S, T, V, or Y;
$Z_3$ is Q, or W;
$Z_4$ is A, D, E, G, H, I, K, L, M, P, R, S, T, or V;
$Z_5$ is A, D, E, G, N, R, S, T, or Y;
$Z_6$ is A, P, R, or S;
$Z_7$ is A, D, F, G, H, L, M, N, Q, R, S, T, V, or Y;
$Z_8$ is A, G, I, K, P, Q, R, S, or T; and
$Z_9$ is F, H, or Y.

In some embodiments, the linkers L1 and L2 are each independently selected from $(GS)_n$ (SEQ ID No.1809), $(GGS)_n$ (SEQ ID No.1810), $(GGGS)_n$ (SEQ ID No.1811), $(GGSG)_n$ (SEQ ID No.1812), $(GGSGG)_n$ (SEQ ID No.1813), or $(GGGGS)_n$ (SEQ ID No.1814), wherein n is 1, 2, 3, 4, 5, 6, 7, 8, 9, or 10, or GGGGSGGGS (SEQ ID No. 1808). In some embodiments, the domains are linked in the order H2N-(A)-(B)-(C)-COOH or by linkers L1 and L2 in the order of H2N-(A)-L1-(B)-L2-(C)-COOH.

One embodiment provides a DLL3 binding protein comprising the following formula:

$$f1\text{-}r1\text{-}f2\text{-}r2\text{-}f3\text{-}r3\text{-}f4$$

wherein, r1 is a complementarity determining region 1 (CDR1) and is identical to or comprises one or more amino acid residue substitutions relative to a sequence selected from the group consisting of SEQ ID Nos. 443-884 and 1887; r2 is a CDR2 and is identical to or comprises one or more amino acid residue substitutions relative to a sequence selected from the group consisting of SEQ ID Nos. 885-1326 and 1888; and r3 is a CDR3 and identical to or comprises one or more amino acid residue substitutions relative to a sequence selected from the group consisting of SEQ ID Nos. 1327-1768 and 1889; and wherein f1, f2, f3 and f4 are framework residues.

One embodiment provides a method for the treatment or amelioration of a proliferative disease, or a tumorous disease, comprising the administration of the DLL3 targeting trispecific protein according to this disclosure, to a subject in need thereof.

One embodiment provides a DLL3 targeting trispecific protein, wherein said protein comprises (a) a first domain (A) which specifically binds to human CD3; (b) a second domain (B) which is a half-life extension domain; and (c) a third domain (C) which specifically binds to a DLL3 protein. In some embodiments, the domains are linked in the order H2N-(A)-(B)-(C)-COOH, H2N-(A)-(C)-(B)-COOH, H2N-(B)-(A)-(C)-COOH, H2N-(B)-(C)-(A)-COOH, H2N-(C)-(B)-(A)-COOH, or H2N-(C)-(A)-(B)-COOH. In some embodiments, the third domain (C) comprises an affinity matured binding molecule. In some embodiments, the affinity matured binding molecule is derived from a parental molecule that specifically binds to the DLL3 protein. In some embodiments, the affinity matured binding molecule is derived from the parental molecule that specifically binds to DLL3, after a round of affinity maturation. In some embodiments, the round of affinity maturation comprises panning a phage display library against the DLL3 protein. In some embodiments, the phage display library is generated by mutating one or more residues of the parental molecule. In some embodiments, the phage display library expresses one or more molecules derived from the parental molecule. In some embodiments, affinity matured binding molecule is selected from the one or more molecules derived from the parental molecule. In some embodiments, the affinity matured DLL3 binding molecule has a greater binding affinity toward the DLL3 protein than a binding affinity of the parental molecule toward the DLL3 protein. In some embodiments, the affinity matured binding DLL3 binding molecule has a binding affinity toward the DLL3 protein that is about 2-fold about 50-fold greater than the binding affinity of the parental molecule toward the DLL3 protein. In some embodiments, the affinity matured binding DLL3 binding molecule has a binding affinity toward the DLL3 protein that is about 3-fold greater than the binding affinity of the parental molecule toward the DLL3 protein. In some embodiments, the third domain (C) comprises a sequence that is at least about 75% identical to a sequence selected from the group consisting of SEQ ID Nos. 1-442 and 1886. In some embodiments, the third domain (C) comprises a sequence that is at least about 75% identical to a sequence selected from the group consisting of SEQ ID Nos. 1-52. In some embodiments, the third domain (C) comprises a CDR1, a CDR2, and a CDR3.

In some embodiments, the CDR1 comprises a sequence selected from the group consisting of SEQ ID Nos. 443-884 and 1887, or one or more amino acid substitutions relative to a sequence selected from the group consisting of SEQ ID Nos. 443-884 and 1887. In some embodiments, the CDR2 comprises a sequence selected from the group consisting of SEQ ID Nos. 885-1326 and 1888, or one or more amino acid substitutions relative to a sequence selected from the group consisting of SEQ ID Nos. 885-1326 and 1888. In some embodiments, the CDR3 comprises a sequence selected from the group consisting of SEQ ID Nos. 1327-1768 and 1889, or one or more substitutions relative to a sequence selected from SEQ ID Nos. 1327-1768 and 1889. In some embodiments, the CDR1 comprises a sequence selected from the group consisting of SEQ ID Nos. 495-528, or one or more amino acid substitutions relative to a sequence selected from the group consisting of SEQ ID Nos.495-528. In some embodiments, the CDR2 comprises a sequence selected from the group consisting of SEQ ID Nos. 937-970, or one or more amino acid substitutions relative to a sequence selected from the group consisting of SEQ ID Nos. 937-970. In some embodiments, the CDR3 comprises a sequence selected from the group consisting of SEQ ID Nos. 1379-1412, or one or more amino acid substitutions relative to a sequence selected from the group consisting of SEQ ID Nos. 1379 to 1412.

In some embodiments, the third domain (C) comprises a sequence that is at least about 80% identical to a sequence selected from the group consisting of SEQ ID Nos. 53-86. In some embodiments, the CDR1 comprises a sequence selected from the group consisting of SEQ ID Nos. 529-809, or more amino acid substitutions relative to a sequence selected from the group consisting of SEQ ID Nos. 529-809. In some embodiments, the CDR2 comprises a sequence that has one or more amino acid substitutions relative to a sequence selected from the group consisting of SEQ ID Nos. 971 to 1251. In some embodiments, the CDR3 comprises a sequence selected from the group consisting of SEQ ID Nos. 1379-1412, or one or more amino acid substitutions relative to a sequence selected from the group consisting of SEQ ID Nos. 1379 to 1412. In some embodiments, the third domain (C) comprises a sequence that is at least about 75% identical to a sequence selected from the group consisting of SEQ ID Nos. 87-367. In some embodiments, the CDR1 comprises a sequence selected from the group consisting of SEQ ID Nos. 810-884, or one or more amino acid substitutions relative to a sequence selected from the group consisting of SEQ ID Nos. 810 to 884. In some embodiments, the CDR2 comprises a sequence selected from the group consisting of SEQ ID Nos. 1252 to 1326, or one or more amino acid substitutions relative to a sequence selected from the group consisting of SEQ ID Nos. 1252 to 1326. In some embodiments, the CDR3 comprises a sequence selected from the group consisting of SEQ ID Nos. 1692 to 1768, or one or more amino acid substitutions relative to a sequence selected from the group consisting of SEQ ID Nos. 1692 to 1768. In some embodiments, the third domain (C) comprises a sequence that is at least about 75% identical to a sequence selected from the group consisting of SEQ ID Nos. 368-442.

One embodiment provides a DLL3 targeting trispecific protein, wherein said protein comprises (a) a first domain (A) which specifically binds to human CD3; (b) a second domain (B) which is a half-life extension domain; and (c) a third domain (C) which specifically binds to DLL3, wherein the third domain comprises the sequence of SEQ ID No.68 or is derived from SEQ ID No.68. In some embodiments, the third domain (C) is derived from SEQ ID No.68. In some embodiments, SEQ ID No.68 comprises a CDR1, a CDR2, and a CDR3. In some embodiments, the CDR1 comprises the following sequence: $GX_1X_2X_3X_4X_5NX_6X_7X_8$. In some embodiments, the CDR2 comprises the following sequence: $GJ_1SJ_2J_3J_4J_5J_6J_7J_8J_9J_{10}SJ_{11}KJ_{12}$ (SEQ ID No. 1895).

In some embodiments, the CDR3 comprises the following sequence: $Z_1Z_2Z_3Z_4Z_5Z_6Z_7Z_8Z_9Z_{10}Z_{11}$. In some embodiments:

$X_1$ is A, E, F, G, I, K, L, N, Q, R, S, T, V, or Y;
$X_2$ is A, G, I, K, P, R, S, T, or V;
$X_3$ is A, D, F, K, L, N, P, Q, R, S, T, or Y;
$X_4$ is A, D, F, H, I, K, L, M, N, P, R, S, T, V, or Y;
$X_5$ is F, I, K, L, M, N, R, S, T, or V;
$X_6$ is A, or G;
$X_7$ is F, I, L, M, T, V, or Y; and
$X_8$ is A, or G.

In some embodiments:
J$_1$ is I, or V;
J$_2$ is A, K, P, R, or S;
J$_3$ is D, or N;
J$_4$ is D, E, G, K, N, Q, R, S, T, or Y;
J$_5$ is S, or T;
J$_6$ is A, E, F, H, I, K, L, N, Q, R, S, T, V, or Y;
J$_7$ is A, I, L, M, V, or Y;
J$_8$ is D, F, H, I, L, N, S, T, V, or Y;
J$_9$ is A, D, E, F, G, I, K, L, N, Q, R, S, T, V, or Y;
J$_{10}$ is A, D, E, G, K, Q, S, or V;
J$_{11}$ is A, or V; and
J$_{12}$ is G, or V.
In some embodiments:
Z$_1$ is F, or Y;
Z$_2$ is G, H, I, K, N, R, S, or T;
Z$_3$ is A, F, H, I, K, L, M, N, P, Q, R, S, T, or Y;
Z$_4$ is A, E, F, G, H, I, K, L, M, N, Q, R, S, T, V, or Y;
Z$_5$ is A, C, D, E, G, H, I, K, L, N, P, Q, R, S, T, W, or Y;
Z$_6$ is G, K, L, R, or T;
Z$_7$ is A, G, H, L, Q, R, S, T, V, or Y;
Z$_8$ is A, D, E, G, H, P, Q, S, T, W, or Y;
Z$_9$ is A, G, I, K, L, M, N, Q, R, S, T, V, or Y;
Z$_{10}$ is A, G, K, P, R, S, T, or V; and
Z$_{11}$ is A, F, S, or Y.

One embodiment provides a DLL3 targeting trispecific protein, wherein said protein comprises (a) a first domain (A) which specifically binds to human CD3; (b) a second domain (B) which is a half-life extension domain; and (c) a third domain (C) which specifically binds to DLL3, wherein the third domain comprises the sequence of SEQ ID No.75 or is derived from SEQ ID No.75. In some embodiments, SEQ ID No.75 comprises a CDR1, a CDR2, and a CDR3, wherein the CDR1 comprises the following sequence: X$_1$X$_2$X$_3$X$_4$X$_5$X$_6$X$_7$SX$_8$A, the CDR2 comprises the following sequence: GJ$_1$SJ$_2$J$_3$GJ$_4$J$_5$J$_6$YJ$_7$J$_8$SVKG (SEQ ID No. 1894), and the CDR3 comprises the following sequence: Z$_1$Z$_2$Z$_3$Z$_4$Z$_5$Z$_6$Z$_7$Z$_8$Z$_9$.

In some embodiments:
X$_1$ is A, D, E, F, G, H, K, L, M, N, Q, R, S, V, W, or Y;
X$_2$ is D, E, H, K, M, P, R, S, T, or Y;
X$_3$ is A, D, G, H, K, N, P, Q, R, S, T, V, or Y;
X$_4$ is K, S, or V;
X$_5$ is A, F, G, H, K, L, M, N, Q, R, S, T, V, W, or Y;
X$_6$ is D, F, H, I, K, L, M, N, Q, R, S, V, or Y;
X$_7$ is L, or M; and
X$_8$ is I, L, M, S, T, or V.
In some embodiments:
J$_1$ is I, or V;
J$_2$ is A, D, E, G, H, I, K, L, N, P, Q, R, S, T, V, or Y;
J$_3$ is A, D, E, G, H, N, R, or T;
J$_4$ is H, P, R, or S;
J$_5$ is A, H, I, K, M, N, Q, R, T, or V;
J$_6$ is A, D, G, H, I, L, M, N, S, T, V, or Y;
J$_7$ is A, F, I, L, M, R, S, T, V, or Y;
J$_8$ is A, D, E, G, H, K, L, N, R, S, or V;
In some embodiments:
Z$_1$ is L, or Y;
Z$_2$ is D, E, G, H, K, N, Q, R, S, T, V, or Y;
Z$_3$ is Q, or W;
Z$_4$ is A, D, E, G, H, I, K, L, M, P, R, S, T, or V;
Z$_5$ is A, D, E, G, N, R, S, T, or Y;
Z$_6$ is A, P, R, or S;
Z$_7$ is A, D, F, G, H, L, M, N, Q, R, S, T, V, or Y;
Z$_8$ is A, G, I, K, P, Q, R, S, or T; and
Z$_9$ is F, H, or Y.

In some embodiments, the third domain (C) comprises a humanized antibody or an antigen binding fragment thereof. In some embodiments, the third domain (C) comprises a single domain antibody, a VHH domain, a scFv, a VH domain, a VL domain, a Fab, a Fab', a non-Ig domain, a ligand, a knottin, or a small molecule entity that specifically binds to DLL3. In some embodiments, the third domain (C) comprises the single domain antibody. In some embodiments, the second domain (B) binds a bulk serum protein. In some embodiments, the second domain (B) comprises a single domain antibody, a VHH domain, a scFv, a VH domain, a VL domain, a Fab, a Fab', a non-Ig domain, a ligand, a knottin, or a small molecule entity that specifically binds to the bulk serum protein. In some embodiments, the second domain (B) comprises the single domain antibody that specifically binds to the bulk serum protein. In some embodiments, the bulk serum protein comprises albumin, transferrin, IgG1, IgG2, IgG4, IgG3, IgA monomer, Factor XIII, Fibrinogen, IgE, pentameric IgM, or Igκ free light chain. In some embodiments, the bulk serum protein comprises the albumin. In some embodiments, the second domain (B) comprises a sequence that is at least about 75% identical to a sequence selected from the group consisting of SEQ ID Nos. 1769-1778. In some embodiments, the second domain (B) comprises a sequence that is at least about 75% identical to SEQ ID No.1774.

In some embodiments, the first domain (A) comprises a single domain antibody, a VHH domain, a scFv, a VH domain, a VL domain, a Fab, a Fab', a non-Ig domain, a ligand, a knottin, or a small molecule entity that specifically binds to CD3. In some embodiments, the first domain (A) comprises a sequence selected from the group consisting of SEQ ID Nos. 1793-1807. In some embodiments, the third domain (C) comprises the following formula:

$$f1\text{-}r1\text{-}f2\text{-}r2\text{-}f3\text{-}r3\text{-}f4$$

wherein, r1 is identical to or comprises one or more amino acid residue substitutions relative to a sequence selected from the group consisting of SEQ ID Nos. 443-884 and 1887; r2 is identical to or comprises one or more amino acid residue substitutions relative to a sequence selected from the group consisting of SEQ ID Nos. 885-1326 and 1888; and r3 is identical to or comprises one or more amino acid residue substitutions relative to a sequence selected from the group consisting of SEQ ID Nos. 1327-1768 and 1889; and wherein f1, f2, f3 and f4 are framework residues. In some embodiments, the third domain (C) comprises a sequence that is at least 75% identical to a sequence selected from the group consisting of SEQ ID Nos. 1-442 and 1886. In some embodiments, the domains C and B are connected by linker L1 and domains B and A are connected by linker L2. In some embodiments, the linkers L1 and L2 are each independently selected from (GS)$_n$ (SEQ ID No.1809), (GGS)$_n$ (SEQ ID No.1810), (GGGS)$_n$ (SEQ ID No.1811), (GGSG)$_n$ (SEQ ID No.1812), (GGSGG)$_n$ (SEQ ID No.1813), or (GGGGS)$_n$ (SEQ ID No.1814), wherein n is 1, 2, 3, 4, 5, 6, 7, 8, 9, or 10. In some embodiments, the linkers L1 and L2 are each independently (GGGGS)$_4$ (SEQ ID No.1817) or (GGGGS)$_3$ (SEQ ID No.1818). In some embodiments, the protein binds to DLL3 with a binding affinity (Kd) of about 0.1 nM to about 50 nM. In some embodiments, the protein binds to human DLL3, cynomolgus DLL3, or both human and cynomolgus DLL3. In some embodiments, the protein is less than about 80 kDa. In some embodiments, the protein is about 50 to about 75 kDa. In some embodiments, the protein is less than about 60 kDa. In some embodiments, the protein has an elimination half-time of at least about 50 hours. In some embodiments, the protein has an elimination half-time of at least about 100 hours. In some embodiments, the protein has increased tissue penetration as compared to an IgG to the same DLL3. In some embodiments, the domains are linked in the order H2N-(A)-(B)-(C)-COOH.

One embodiment provides a pharmaceutical composition comprising (i) the DLL3 targeting trispecific protein according to any one of above embodiments or a DLL3 binding protein according to this disclosure, and (ii) a pharmaceutically acceptable carrier. One embodiment provides a method for preparing a DLL3 targeting trispecific binding protein according to any one of above embodiments, the method comprising: i) providing a DLL3 protein or a fragment thereof; ii) exposing a recombinant library of DLL3 binding proteins to the DLL3 protein or a fragment thereof; iii) selecting from the library a DLL3 binding protein which specifically binds to said oligomer or derivative thereof; and (iv) preparing the DLL3 targeting trispecific protein using the DLL3 binding protein identified in step (iii). In some embodiments, the recombinant library of DLL3 binding proteins is exposed to the DLL3 protein in vitro by screening the recombinant library with said DLL3 protein. In some embodiments, the recombinant library is expressed on the surface of a bacteriophage. In some embodiments, the recombinant library is expressed on the surface of yeast cells. In some embodiments, the recombinant library is expressed on the surface of bacterial cells. In some embodiments, the recombinant library is expressed as RNA-protein fusions. In some embodiments, the recombinant library is an scFv library or an Fab library. In some embodiments, the recombinant antibody library is a single domain library.

One embodiment provides a process for the production of a DLL3 targeting trispecific protein according to any one of above embodiments, said process comprising culturing a host transformed or transfected with a vector comprising a nucleic acid sequence encoding the DLL3 trispecific protein according to any one of above embodiments under conditions allowing the expression of the DLL3 targeting trispecific protein and recovering and purifying the produced protein from the culture.

One embodiment provides a DLL3 binding protein comprising the following formula:

$$f1-r1-f2-r2-f3-r3-f4$$

wherein, r1 is a complementarity determining region 1 (CDR1) and is identical to or comprises one or more amino acid residue substitutions relative to a sequence selected from the group consisting of SEQ ID Nos. 443-884 and 1887; r2 is a CDR2 and is identical to or comprises one or more amino acid residue substitutions relative to a sequence selected from the group consisting of SEQ ID Nos. 885-1326 and 1888; and r3 is a CDR3 and identical to or comprises one or more amino acid residue substitutions relative to a sequence selected from the group consisting of SEQ ID Nos. 1327-1768 and 1889; and wherein f1, f2, f3 and f4 are framework residues. In some embodiments, the DLL3 binding protein comprises a sequence that is at least about 75% identical to a sequence selected from the group consisting of SEQ ID Nos. 1-442 and 1886. In some embodiments, the DLL3 binding protein comprises a sequence that is at least about 75% identical to a sequence selected from the group consisting of SEQ ID Nos. 1-52. In some embodiments, the DLL3 binding protein comprises a sequence that is at least about 75% identical to a sequence selected from the group consisting of SEQ ID Nos. 53-86. In some embodiments, the DLL3 binding protein comprises a sequence that is at least about 75% identical to a sequence selected from the group consisting of SEQ ID Nos. 87-367. In some embodiments, the DLL3 binding protein comprises a sequence that is at least about 75% identical to a sequence selected from the group consisting of SEQ ID Nos. 368-442. One embodiment provides a DLL3 binding protein that is derived from a parental DLL3 binding protein comprising the sequence of SEQ ID No. 68. One embodiment provides a DLL3 binding protein that is derived from a parental DLL3 binding protein comprising the sequence of SEQ ID No. 75 or comprises the sequence of SEQ ID No. 75.

One embodiment provides a method for preparing a DLL3 binding protein according to this disclosure, the method comprising: i) providing a DLL3 protein or a fragment thereof; ii) exposing a recombinant library of DLL3 binding proteins to the DLL3 protein or a fragment thereof; iii) selecting from the library a DLL3 binding protein which specifically binds to said oligomer or derivative thereof. In some embodiments, the recombinant library of DLL3 binding proteins is exposed to the DLL3 protein in vitro by screening the recombinant library with said DLL3 protein. In some embodiments, the recombinant library is expressed on the surface of a bacteriophage. In some embodiments, the recombinant library is expressed on the surface of yeast cells. In some embodiments, the recombinant library is expressed on the surface of bacterial cells. In some embodiments, the recombinant library is expressed as RNA-protein fusions. In some embodiments, the recombinant library is an scFv library or an Fab library. In some embodiments, the recombinant antibody library is a single domain library.

One embodiment provides a process for the production of a DLL3 binding protein according to this disclosure, said process comprising culturing a host transformed or transfected with a vector comprising a nucleic acid sequence encoding the DLL3 binding protein according to this disclosure under conditions allowing the expression of the DLL3 binding protein and recovering and purifying the produced protein from the culture.

One embodiment provides a method for the treatment or amelioration of a proliferative disease, or a tumorous disease, comprising the administration of the DLL3 targeting trispecific protein according to any one of above embodiments, a DLL3 binding protein according to this disclosure, or a pharmaceutical composition as provided herein, to a subject in need thereof. In some embodiments, the subject is human. In some embodiments, the method further comprises administration of an agent in combination with the DLL3 targeting trispecific protein according to any one of above embodiments, the DLL3 binding protein according to this disclosure, or the pharmaceutical composition as provided herein. In some embodiments, the DLL3 targeting trispecific protein or the DLL3 binding protein selectively binds to tumor cells expressing DLL3. In some embodiments, the DLL3 targeting trispecific protein mediates T cell killing of tumor cells expressing DLL3. In some embodiments, the tumorous disease comprises a solid tumor disease. In some embodiments, the solid tumor disease comprises lung cancer, gastric cancer, ovarian cancer, or triple negative breast cancer. In some embodiments, in the solid tumor disease is metastatic.

One embodiment provides a method for the treatment or amelioration of a proliferative disease, or a tumorous disease, comprising administration of a DLL3 targeting trispecific protein comprising a DLL3 binding domain comprising sequence selected from the group consisting of SEQ ID Nos. 1-442 and 1886, or a DLL3 binding protein comprising a sequence selected from the group consisting of SEQ ID Nos. 1-442 and 1886. In some embodiments, the DLL3 targeting trispecific protein or the DLL3 binding protein selectively binds to tumor cells expressing DLL3. In some embodiments, the DLL3 targeting trispecific protein directs T cell killing of tumor cells expressing DLL3. In some embodiments, the tumorous disease comprises a solid tumor disease. In some embodiments, the solid tumor disease comprises lung cancer, gastric cancer, ovarian cancer, or triple negative breast cancer. In some embodiments, the solid tumor disease is metastatic.

One embodiment provides a method for the treatment or amelioration of a proliferative disease, or a tumorous disease, comprising administration of a DLL3 binding domain comprising a sequence as set forth in SEQ ID No. 68 or 75 or a DLL3 binding protein comprising a sequence as set forth in SEQ ID No. 68 or 75. In some embodiments, the DLL3 targeting trispecific protein or the DLL3 binding protein at a dose of up to 10 mg/kg. In some embodiments, the protein is administered at least once a week. In some embodiments, the protein is administered twice per week. In some embodiments, the protein is administered every other week. In some embodiments, the protein is administered every three weeks.

In one embodiment is provided a DLL3 binding protein comprising an amino acid sequence as set forth in SEQ ID No. 1890 or SEQ ID No. 1891.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

DETAILED DESCRIPTION OF THE INVENTION

Figure 1:
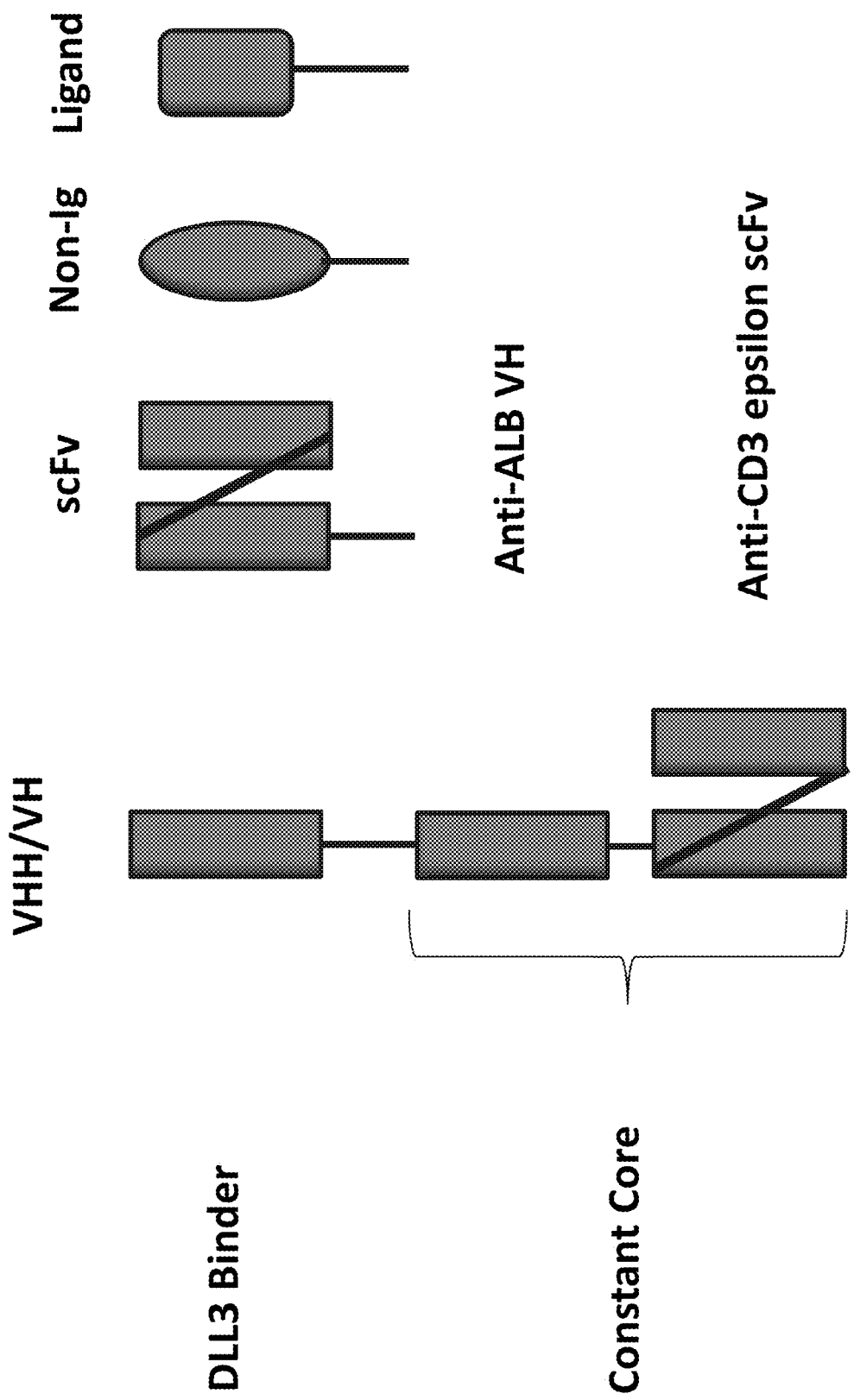
FIG. 1 illustrates the various domains of an exemplary DLL3 targeting trispecific protein of this disclosure.

Described herein, in some embodiments, are proteins that specifically bind delta-like ligand 3 (DLL3) and multispecific (e.g., trispecific) containing the same, pharmaceutical compositions thereof, as well as nucleic acids, recombinant expression vectors and host cells for making such proteins thereof. Also provided are methods of using at least one of: the disclosed DLL3 binding proteins, or DLL3 targeting trispecific proteins containing the same, in the prevention, and/or treatment of diseases, conditions and disorders. The DLL3 targeting trispecific proteins are capable of specifically binding to DLL3 as well as CD3 and have a half-life extension domain, such as a domain that is capable of specifically binding to human albumin (ALB). FIG. 1 depicts one non-limiting example of a trispecific DLL3-binding protein. In some embodiments, the DLL3 targeting trispecific protein comprises an antibody, such as a trispecific antibody.

Certain Definitions

An "antibody" typically refers to a Y-shaped tetrameric protein comprising two heavy (H) and two light (L) polypeptide chains held together by covalent disulfide bonds and non-covalent interactions. Human light chains comprise a variable domain (VL) and a constant domain (CL) wherein the constant domain may be readily classified as kappa or lambda based on amino acid sequence and gene loci. Each heavy chain comprises one variable domain (VH) and a constant region, which in the case of IgG, IgA, and IgD, comprises three domains termed CH1, CH2, and CH3 (IgM and IgE have a fourth domain, CH4). In IgG, IgA, and IgD classes the CH1 and CH2 domains are separated by a flexible hinge region, which is a proline and cysteine rich segment of variable length (generally from about 10 to about 60 amino acids in IgG). The variable domains in both the light and heavy chains are joined to the constant domains by a "J" region of about 12 or more amino acids and the heavy chain also has a "D" region of about 10 additional amino acids. Each class of antibody further comprises inter-chain and intra-chain disulfide bonds formed by paired cysteine residues. There are two types of native disulfide bridges or bonds in immunoglobulin molecules: interchain and intra-chain disulfide bonds. The location and number of interchain disulfide bonds vary according to the immunoglobulin class and species. Interchain disulfide bonds are located on the surface of the immunoglobulin, are accessible to solvent and are usually relatively easily reduced. In the human IgG1 isotype there are four interchain disulfide bonds, one from each heavy chain to the light chain and two between the heavy chains. The interchain disulfide bonds are not required for chain association. As is well known the cysteine rich IgG1 hinge region of the heavy chain has generally been held to consist of three parts: an upper hinge, a core hinge, and a lower hinge. Those skilled in the art will appreciate that that the IgG1 hinge region contain the cysteines in the heavy chain that comprise the interchain disulfide bonds (two heavy/heavy, two heavy/light), which provide structural flexibility that facilitates Fab movements. The interchain disulfide bond between the light and heavy chain of IgG1 are formed between C214 of the kappa or lambda light chain and C220 in the upper hinge region of the heavy chain. The interchain disulfide bonds between the heavy chains are at positions C226 and C229 (all numbered per the EU index according to Kabat, et al., infra.)

As used herein the term "antibody" includes polyclonal antibodies, multiclonal antibodies, monoclonal antibodies, chimeric antibodies, humanized and primatized antibodies, CDR grafted antibodies, human antibodies, recombinantly produced antibodies, intrabodies, multispecific antibodies, bispecific antibodies, monovalent antibodies, multivalent antibodies, anti-idiotypic antibodies, synthetic antibodies, including muteins and variants thereof, immunospecific antibody fragments such as Fd, Fab, F(ab')2, F(ab') fragments, single-chain fragments (e.g., ScFv and ScFvFc), disulfide-linked Fvs (sdFv), a Fd fragment consisting of the VH and CH1 domains, linear antibodies, single domain antibodies such as sdAb (VH, VL, or VHH domains); and derivatives thereof including Fc fusions and other modifications, and any other immunoreactive molecule so long as it comprises a domain having a binding site for preferential association or binding with a DLL3 protein. Moreover, unless dictated otherwise by contextual constraints the term further comprises all classes of antibodies (i.e. IgA, IgD, IgE, IgG, and IgM) and all subclasses (i.e., IgG1, IgG2, IgG3, IgG4, IgA1, and IgA2). Heavy-chain constant domains that correspond to the different classes of antibodies are typically denoted by the corresponding lower case Greek letter alpha, delta, epsilon, gamma, and mu, respectively. Light chains of the antibodies from any vertebrate species can be assigned to one of two clearly distinct types, called kappa (kappa) and lambda (lambda), based on the amino acid sequences of their constant domains.

In some embodiments, the DLL3 binding domain of the DLL3 targeting trispecific proteins of this disclosure comprise a heavy chain only antibody, such as a VH or a VHH domain. In some cases, the DLL3 binding proteins comprise a heavy chain only antibody that is an engineered human VH domain. In some examples, the engineered human VH domain is produced by panning of phage display libraries. In some embodiments, the DLL3 binding domain of the DLL3 targeting trispecific proteins of this disclosure comprise a VHH. The term "VHH," as used herein, refers to single chain antibody binding domain devoid of light chain. In some cases, a VHH is derived from an antibody of the type that can be found in Camelidae or cartilaginous fish which are naturally devoid of light chains or to a synthetic and non-immunized VHH which can be constructed accordingly. Each heavy chain comprises a variable region encoded by V-, D- and J exons. A VHH, in some cases, is a natural VHH, such as a Camelid-derived VHH, or a recombinant protein comprising a heavy chain variable domain. In some embodiments, the VHH is derived from a species selected from the group consisting of camels, llamas, vicugnas, guanacos, and cartilaginous fish (such as, but not limited to, sharks). In another embodiment, the VHH is derived from an alpaca (such as, but not limited to, a Huacaya Alpaca or a Suri alpaca).

As used herein, "Variable region" or "variable domain" refers to the fact that certain portions of the variable domains differ extensively in sequence among antibodies and are used in the binding and specificity of each particular antibody for its particular antigen. However, the variability is not evenly distributed throughout the variable domains of antibodies. It is concentrated in three segments called complementarity-determining regions (CDRs) or hypervariable regions both in the light-chain (VL) and the heavy-chain (VH) variable domains. The more highly conserved portions of variable domains are called the framework (FR). The variable domains of native heavy and light chains each comprise four FR regions, largely adopting a β-sheet configuration, connected by three CDRs, which form loops connecting, and in some cases forming part of, the β sheet structure. The CDRs in each chain are held together in close proximity by the FR regions and, with the CDRs from the other chain, contribute to the formation of the antigen-binding site of antibodies (see Kabat et al., Sequences of Proteins of Immunological Interest, Fifth Edition, National Institute of Health, Bethesda, Md. (1991)). The constant domains are not involved directly in binding an antibody to an antigen, but exhibit various effector functions, such as participation of the antibody in antibody-dependent cellular toxicity. ScFv fragments (for single chain fragment variable), which in some cases are obtained by genetic engineering, associates in a single polypeptide chain, the VH and the VL region of an antibody, separated by a peptide linker.

In some embodiments of this disclosure, the DLL3 binding domain, such as the DLL3 binding domain of the DLL3 targeting trispecific proteins comprise a single domain antibody, such as heavy chain only antibodies, such as VH or VHH domains, and comprise three CDRs. Such heavy chain only antibodies, in some embodiments, bind DLL3 as a monomer with no dependency on dimerisation with a VL (light chain variable) region for optimal binding affinity. In some embodiments of this disclosure, the CD3 binding domain of the DLL3 targeting trispecific proteins comprises an scFv. In some embodiments of this disclosure, the albumin binding domain of the DLL3 targeting trispecific proteins comprise a heavy chain only antibody, such as a single domain antibody comprising a VH domain or a VHH domain.

The assignment of amino acids to each domain, framework region and CDR is, in some embodiments, in accordance with one of the numbering schemes provided by Kabat et al. (1991) Sequences of Proteins of Immunological Interest (5th Ed.), US Dept. of Health and Human Services, PHS, NIH, NIH Publication no. 91-3242; Chothia et al., 1987, PMID: 3681981; Chothia et al., 1989, PMID: 2687698; MacCallum et al., 1996, PMID: 8876650; or Dubel, Ed. (2007) Handbook of Therapeutic Antibodies, 3rd Ed., Wily-VCH Verlag GmbH and Co or AbM (Oxford Molecular/MSI Pharmacopia) unless otherwise noted. It is not intended that CDRs of the present disclosure necessarily correspond to the Kabat numbering convention. In some embodiments of this disclosure, the DLL3 binding proteins comprise single domain antibodies, such as heavy chain only antibodies, such as VH or VHH domains, and comprise three CDRs. Such heavy chain only antibodies, in some embodiments, bind DLL3 as a monomer with no dependency on dimerisation with a VL (light chain variable) region for optimal binding affinity.

"Variable domain residue numbering as in Kabat" or "amino acid position numbering as in Kabat," and variations thereof, refers to the numbering system used for heavy chain variable domains or light chain variable domains of the compilation of antibodies in Kabat et al., Sequences of Proteins of Immunological Interest, 5th Ed. Public Health Service, National Institutes of Health, Bethesda, Md. (1991). Using this numbering system, the actual linear amino acid sequence may contain fewer or additional amino acids corresponding to a shortening of, or insertion into, a FR or CDR of the variable domain. For example, a heavy chain variable domain may include a single amino acid insert (residue 52a according to Kabat) after residue 52 of H2 and inserted residues (e.g., residues 82a, 82b, and 82c, etc according to Kabat) after heavy chain FR residue 82. The Kabat numbering of residues may be determined for a given antibody by alignment at regions of homology of the sequence of the antibody with a "standard" Kabat numbered sequence.

The term "Framework" or "FR" residues (or regions) refer to variable domain residues other than the CDR or hypervariable region residues as herein defined. A "human consensus framework" is a framework which represents the most commonly occurring amino acid residue in a selection of human immunoglobulin VL or VH framework sequences.

As used herein, the term "Percent (%) amino acid sequence identity" with respect to a sequence is defined as the percentage of amino acid residues in a candidate sequence that are identical with the amino acid residues in the specific sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer softwares such as EMBOSS MATCHER, EMBOSS WATER, EMBOSS STRETCHER, EMBOSS NEEDLE, EMBOSS LALIGN, BLAST, BLAST-2, ALIGN or Megalign (DNASTAR) software. Those skilled in the art can determine appropriate parameters for measuring alignment, including any algorithms needed to achieve maximal alignment over the full length of the sequences being compared.

As used herein, "elimination half-time" is used in its ordinary sense, as is described in Goodman and Gillman's The Pharmaceutical Basis of Therapeutics 21-25 (Alfred Goodman Gilman, Louis S. Goodman, and Alfred Gilman, eds., 6th ed. 1980). Briefly, the term is meant to encompass a quantitative measure of the time course of drug elimination. The elimination of most drugs is exponential (i.e., follows first-order kinetics), since drug concentrations usually do not approach those required for saturation of the elimination process. The rate of an exponential process may be expressed by its rate constant, k, which expresses the fractional change per unit of time, or by its half-time, t1/2 the time required for 50% completion of the process. The units of these two constants are time-1 and time, respectively. A first-order rate constant and the half-time of the reaction are simply related (k×t1/2=0.693) and may be interchanged accordingly. Since first-order elimination kinetics dictates that a constant fraction of drug is lost per unit time, a plot of the log of drug concentration versus time is linear at all times following the initial distribution phase (i.e. after drug absorption and distribution are complete). The half-time for drug elimination can be accurately determined from such a graph.

As used herein, the term "binding affinity" refers to the affinity of the proteins described in the disclosure to their binding targets, and is expressed numerically using "Kd" values. If two or more proteins are indicated to have comparable binding affinities towards their binding targets, then the Kd values for binding of the respective proteins towards their binding targets, are within ±2-fold of each other. If two or more proteins are indicated to have comparable binding affinities towards single binding target, then the Kd values for binding of the respective proteins towards said single binding target, are within ±2-fold of each other. If a protein is indicated to bind two or more targets with comparable binding affinities, then the Kd values for binding of said protein to the two or more targets are within ±2-fold of each other. In general, a higher Kd value corresponds to a weaker binding. In some embodiments, the "Kd" is measured by a radiolabeled antigen binding assay (MA) or surface plasmon resonance assays using a BIAcore™-2000 or a BIAcore™-3000 (BIAcore, Inc., Piscataway, N.J.). In certain embodiments, an "on-rate" or "rate of association" or "association rate" or "kon" and an "off-rate" or "rate of dissociation" or "dissociation rate" or "koff" are also determined with the surface plasmon resonance technique using a BIAcore™-2000 or a BIAcore™-3000 (BIAcore, Inc., Piscataway, N.J.). In additional embodiments, the "Kd", "kon", and "koff" are measured using the OCTET® Systems (Pall Life Sciences). In an exemplary method for measuring binding affinity using the OCTET® Systems, the ligand, e.g., biotinylated human or cynomolgus DLL3, is immobilized on the OCTET® streptavidin capillary sensor tip surface which streptavidin tips are then activated according to manufacturer's instructions using about 20-50 μg/ml human or cynomolgus DLL3 protein. A solution of PBS/Casein is also introduced as a blocking agent. For association kinetic measurements, DLL3 binding protein variants are introduced at a concentration ranging from about 10 ng/mL to about 100 μg/mL, about 50 ng/mL to about 5 μg/mL, or about 2 ng/mL to about 20 μg/mL. In some embodiments, the DLL3 binding single domain proteins are used at a concentration ranging from about 2 ng/mL to about 20 μg/mL. Complete dissociation is observed in case of the negative control, assay buffer without the binding proteins. The kinetic parameters of the binding reactions are then determined using an appropriate tool, e.g., ForteBio software.

One embodiment provides a DLL3 binding protein (also referred to herein as an DLL3 binding domain, such as the DLL3 binding domain of a DLL3 trispecific antibody of this disclosure) that comprises a single domain antibody, comprising a CDR1 sequence comprising a sequence selected from the group consisting of SEQ ID Nos. 443-884 and 1887, a CDR2 sequence comprising a sequence selected from the group consisting of SEQ ID Nos. 885-1326 and 1888, and a CDR3 sequence comprising a sequence selected from the group consisting of SEQ ID Nos. 1327-1768 and 1889. It is contemplated that in some embodiments the DLL3 binding protein of this disclosure is fairly small and no more than 25 kD, no more than 20 kDa, no more than 15 kDa, or no more than 10 kDa in some embodiments. In certain instances, the EGFR binding is 5 kDa or less if it is a peptide or a small molecule entity.

In one aspect, the DLL3 targeting trispecific protein (also referred to herein as a DLL3 binding trispecific protein, a DLL3 trispecific protein, or a DLL3 TriTAC™) comprises (a) a first domain (A) which specifically binds to human CD3; (b) a second domain (B) which is a half-life extension domain; and (c) a third domain (C) which specifically binds to DLL3. The three domains in DLL3 targeting trispecific proteins are arranged in any order. Thus, it is contemplated that the domain order of the DLL3 targeting trispecific proteins are:
  H2N-(A)-(B)-(C)-COOH,
  H2N-(A)-(C)-(B)-COOH,
  H2N-(B)-(A)-(C)-COOH,
  H2N-(B)-(C)-(A)-COOH,
  H2N-(C)-(B)-(A)-COOH, or
  H2N-(C)-(A)-(B)-COOH.

In some embodiments, the DLL3 targeting trispecific proteins have a domain order of H2N-(A)-(B)-(C)-COOH. In some embodiments, the DLL3 targeting trispecific proteins have a domain order of H2N-(A)-(C)-(B)-COOH. In some embodiments, the DLL3 targeting trispecific proteins have a domain order of H2N-(B)-(A)-(C)-COOH. In some embodiments, the DLL3 targeting trispecific proteins have a domain order of H2N-(B)-(C)-(A)-COOH. In some embodiments, the DLL3 targeting trispecific proteins have a domain order of H2N-(C)-(B)-(A)-COOH. In some embodiments, the DLL3 targeting trispecific proteins have a domain order of H2N-(C)-(A)-(B)-COOH.

In some embodiments, the DLL3 targeting trispecific proteins have the HSA (also referred to herein as ALB) binding domain as the middle domain, such that the domain order is H2N-(A)-(B)-(C)-COOH or H2N-(C)-(B)-(A)-COOH. It is contemplated that in such embodiments where the HSA binding domain as the middle domain, the CD3 and DLL3 binding domains are afforded additional flexibility to bind to their respective targets.

In some embodiments, the trispecific binding protein comprises a third domain that specifically binds DLL3, which third domain is in some cases a DLL3 binding single domain antibody, which binds to DLL3 with equivalent or better affinity as that of a reference DLL3 binding parental molecule. The third domain in some embodiments comprises an affinity matured DLL3 binding molecule (e.g., an affinity matured DLL3 binding single domain antibody), and is derived from the DLL3 binding parental molecule, comprising one or more amino acid mutations (e.g., a stabilizing mutation, a destabilizing mutation) with respect to the DLL3 binding parental molecule. In some embodiments, the affinity matured DLL3 binding molecule has superior stability with respect to selected destabilizing agents, as that of a reference DLL3 binding parental molecule. In some embodiments, the affinity matured DLL3 binding molecule is identified in a process comprising panning of one or more pre-candidate DLL3 binding molecules derived from one or more DLL3 binding parental molecule, expressed in a phage display library, against a DLL3 protein, such as a human DLL3 protein. The pre-candidate DLL3 binding molecule comprises, in some embodiments, amino acid substitutions in the variable regions, CDRs, or framework residues, relative to a parental molecule.

As used herein, "Phage display" refers to a technique by which variant polypeptides are displayed as fusion proteins to at least a portion of a coat protein on the surface of phage, filamentous phage, particles. A utility of phage display lies in the fact that large libraries of randomized protein variants can be rapidly and efficiently selected for those sequences that bind to a target molecule with high affinity. Display of peptide and protein libraries on phage has been used for screening millions of polypeptides for ones with specific binding properties. Polyvalent phage display methods have been used for displaying small random peptides and small proteins through fusions to either gene III or gene VIII of filamentous phage. Wells and Lowman, Curr. Opin. Struct. Biol, 3:355-362 (1992), and references cited therein. In monovalent phage display, a protein or peptide library is fused to a gene III or a portion thereof, and expressed at low levels in the presence of wild type gene III protein so that phage particles display one copy or none of the fusion proteins. Avidity effects are reduced relative to polyvalent phage so that selection is on the basis of intrinsic ligand affinity, and phagemid vectors are used, which simplify DNA manipulations. Lowman and Wells, Methods: A companion to Methods in Enzymology, 3:205-0216 (1991).

In some embodiments, the panning comprises using varying binding times and concentrations to identify DLL3 binding molecules with increased or decreased on-rates, from pre-candidate DLL3 binding molecules. In some embodiments, the panning comprises using varying wash times to identify DLL3 binding molecules with increased or decreased off-rates, from pre-candidate DLL3 molecules. In some embodiments, the panning comprises using both varying binding times and varying wash times. In some embodiments, one or more stabilizing mutations are combined to increase the stability of the affinity matured DLL3 binding molecule, for example, by shuffling to create a second-stage combinatorial library from such mutants and conducting a second round of panning followed by a binding selection.

In some embodiments, the affinity matured DLL3 binding molecule comprises an equivalent or better affinity to a DLL3 protein (such as human DLL3 protein) as that of a DLL3 binding parental molecule, but that has reduced cross reactivity, or in some embodiments, increased cross reactivity, with selected substances, such as ligands, proteins, antigens, or the like, other than the DLL3 epitope for which the DLL3 binding parental molecule is specific, or is designed to be specific for. In regard to the latter, an affinity matured DLL3 binding molecule, in some embodiments, is more successfully tested in animal models if the affinity matured DLL3 binding molecule is reacted with both human DLL3 and the corresponding target of the animal model, mouse DLL3 or cynomolgus DLL3. In some embodiments, the parental DLL3 binding molecule binds to human DLL3 with an affinity of about 10 nM or less, and to cynomolgus DLL3 with an affinity of about 15 nM or less. In some embodiments, the affinity matured DLL3 binding molecule, identified after one round of panning, binds to human DLL3 with an affinity of about 5 nM or less, and to cynomolgus DLL3 with an affinity of about 7.5 nM or less. In some embodiments, the affinity matured DLL3 binding molecule, identified after two rounds of panning, binds to human DLL3 with an affinity of about 2.5 nM or less, and to cynomolgus DLL3 with an affinity of about 3.5 nM or less.

In some embodiments, domain A, domain B, and domain C of the trispecific binding protein of this disclosure, are independently antigen-specific binding domain polypeptides that specifically bind to targets, such as targets on diseased cells, or targets on other cells that support the diseased state, such as targets on stromal cells that support tumor growth or targets on immune cells that support disease-mediated immunosuppression. In some examples, the antigen-specific binding domains include antibodies, heavy chain only antibodies, including single chain antibodies, Fabs, Fv, T-cell receptor binding domains, ligand binding domains, receptor binding domains, domain antibodies, single domain antibodies, minibodies, nanobodies, peptibodies, or various other antibody mimics (such as affimers, affitins, alphabodies, atrimers, CTLA4-based molecules, adnectins, anticalins, Kunitz domain-based proteins, avimers, knottins, fynomers, darpins, affibodies, affilins, monobodies and armadillo repeat protein-based proteins).

In some embodiments, the DLL3 targeting trispecific proteins described herein comprise a DLL binding polypeptide having a sequence selected from the group consisting of SEQ ID Nos. 1-442 and 1886, subsequences thereof, and variants thereof. In some embodiments, the trispecific antigen binding protein comprises a DLL3 binding polypeptide (i.e., the third domain (C)) having at least 70%-95% or more homology to a sequence selected from SEQ ID Nos. 1-442 and 1886, subsequences thereof, and variants thereof. In some embodiments, the trispecific antigen binding protein comprises a DLL3 binding polypeptide (i.e., the third domain (C)) having at least 70%, 75%, 80%, 85%, 90%, 95%, 96%, 97%, 98%, 99%, or more homology to a sequence selected from the group consisting of SEQ ID Nos.

1-442 and 1886, subsequences thereof, and variants thereof. In some embodiments, the trispecific antigen binding protein comprises a DLL3 binding polypeptide (i.e., the third domain (C)) having at least 70%-95% or more identity to a sequence selected from SEQ ID Nos. 1-442 and 1886, subsequences thereof, and variants thereof. In some embodiments, the trispecific antigen binding protein comprises a DLL3 binding polypeptide (i.e., the third domain (C)) having at least 70%, 75%, 80%, 85%, 90%, 91%, 92%, 93%, 94%, 95%, 96%, 97%, 98%, 99% or more identity to a sequence selected from the group consisting of SEQ ID Nos. 1-442 and 1886, subsequences thereof, and variants thereof.

The DLL3 targeting trispecific proteins described herein are designed to allow specific targeting of cells expressing DLL3 by recruiting cytotoxic T cells. In some embodiments, this improves efficacy compared to ADCC (antibody dependent cell-mediated cytotoxicity), which is using full length antibodies directed to a sole antigen and is not capable of directly recruiting cytotoxic T cells. In contrast, by engaging CD3 molecules expressed specifically on these cells, the DLL3 targeting trispecific proteins can crosslink cytotoxic T cells with cells expressing DLL3 in a highly specific fashion, thereby directing the cytotoxic potential of the T cell towards the target cell. The DLL3 targeting trispecific proteins described herein engage cytotoxic T cells via binding to the surface-expressed CD3 proteins, which form part of the TCR. Simultaneous binding of several DLL3 trispecific antigen-binding protein to CD3 and to DLL3 expressed on the surface of particular cells causes T cell activation and mediates the subsequent lysis of the particular DLL3 expressing cell. Thus, DLL3 targeting trispecific proteins are contemplated to display strong, specific and efficient target cell killing. In some embodiments, the DLL3 targeting trispecific proteins described herein stimulate target cell killing by cytotoxic T cells to eliminate pathogenic cells (e.g., tumor cells expressing DLL3). In some of such embodiments, cells are eliminated selectively, thereby reducing the potential for toxic side effects.

The DLL3 targeting trispecific proteins described herein confer further therapeutic advantages over traditional monoclonal antibodies and other smaller bispecific molecules. Generally, the effectiveness of recombinant protein pharmaceuticals depends heavily on the intrinsic pharmacokinetics of the protein itself. One such benefit here is that the DLL3 targeting trispecific proteins described herein have extended pharmacokinetic elimination half-time due to having a half-life extension domain such as a domain that specifically binds to a serum albumin protein (e.g., a human serum albumin protein, HSA). In this respect, the DLL3 targeting trispecific proteins described herein have an extended serum elimination half-time of about two, three, about five, about seven, about 10, about 12, or about 14 days in some embodiments. This contrasts to other binding proteins such as BiTE or DART molecules which have relatively much shorter elimination half-times. For example, the BiTE CD19×CD3 bispecific scFv-scFv fusion molecule requires continuous intravenous infusion (i.v.) drug delivery due to its short elimination half-time. The longer intrinsic half-times of the DLL3 targeting trispecific proteins solve this issue thereby allowing for increased therapeutic potential such as low-dose pharmaceutical formulations, decreased periodic administration and/or novel pharmaceutical compositions.

The DLL3 targeting trispecific proteins described herein also have an optimal size for enhanced tissue penetration and tissue distribution. Larger sizes limit or prevent penetration or distribution of the protein in the target tissues. The DLL3 targeting trispecific proteins described herein avoid this by having a small size that allows enhanced tissue penetration and distribution. Accordingly, the DLL3 targeting trispecific proteins described herein, in some embodiments have a size of about 50 kDa to about 80 kDa, about 50 kDa to about 75 kDa, about 50 kDa to about 70 kDa, or about 50 kDa to about 65 kDa. In some embodiments, the size of the DLL3 targeting trispecific protein is smaller than about 60 kDa. Thus, the size of the DLL3 targeting trispecific proteins is advantageous over IgG antibodies which are about 150 kDa and the BiTE and DART diabody molecules which are about 55 kDa but are not half-life extended and therefore cleared quickly through the kidney.

In further embodiments, the DLL3 targeting trispecific proteins described herein have an optimal size for enhanced tissue penetration and distribution. In these embodiments, the DLL3 targeting trispecific proteins are constructed to be as small as possible, while retaining specificity toward its targets. Accordingly, in these embodiments, the DLL3 targeting trispecific proteins described herein have a size of about 20 kDa to about 40 kDa or about 25 kDa to about 35 kDa to about 40 kDa, to about 45 kDa, to about 50 kDa, to about 55 kDa, to about 60 kDa, to about 65 kDa. In some embodiments, the DLL3 targeting trispecific proteins described herein have a size of about 50 kDa, 49, kDa, 48 kDa, 47 kDa, 46 kDa, 45 kDa, 44 kDa, 43 kDa, 42 kDa, 41 kDa, 40 kDa, about 39 kDa, about 38 kDa, about 37 kDa, about 36 kDa, about 35 kDa, about 34 kDa, about 33 kDa, about 32 kDa, about 31 kDa, about 30 kDa, about 29 kDa, about 28 kDa, about 27 kDa, about 26 kDa, about 25 kDa, about 24 kDa, about 23 kDa, about 22 kDa, about 21 kDa, or about 20 kDa. An exemplary approach to the small size is through the use of single domain antibody (sdAb) fragments for each of the domains. For example, a particular DLL3 trispecific antigen-binding protein has an anti-CD3 sdAb, anti-ALB sdAb and an sdAb for DLL3. This reduces the size of the exemplary DLL3 trispecific antigen-binding protein to under 60 kDa. Thus in some embodiments, the domains of the DLL3 targeting trispecific proteins are all single domain antibody (sdAb) fragments. It is contemplated that in some embodiments the DLL3 binding protein is fairly small and no more than 25 kDa, no more than 20 kDa, no more than 15 kDa, or no more than 10 kDa in some embodiments. In certain instances, the DLL3 binding protein is 5 kDa or less if it is a peptide or small molecule entity.

In other embodiments, the DLL3 targeting trispecific proteins described herein comprise small molecule entity (SME) binders for ALB, DLL3, CD3, or all. SME binders are small molecules averaging about 500 to 2000 Da in size and are attached to the DLL3 targeting trispecific proteins by known methods, such as sortase ligation or conjugation. In these instances, one of the domains of DLL3 trispecific antigen-binding protein is a sortase recognition sequence, LPETG (SEQ ID No: 1896). To attach a SME binder to DLL3 trispecific antigen-binding protein with a sortase recognition sequence, the protein is incubated with a sortase and a SME binder whereby the sortase attaches the SME binder to the recognition sequence. In yet other embodiments, the domain which binds to DLL3 of DLL3 targeting trispecific proteins described herein comprise a knottin peptide for binding DLL3. Knottins are disufide-stabilized peptides with a cysteine knot scaffold and have average sizes about 3.5 kDa. Knottins have been contemplated for binding to certain tumor molecules such as DLL3. In further embodiments, the third domain which binds to DLL3 of DLL3 targeting trispecific proteins described herein comprise a natural DLL3 ligand.

Another feature of the DLL3 targeting trispecific proteins described herein is that they are of a single-polypeptide design with flexible linkage of their domains. This allows for facile production and manufacturing of the DLL3 targeting trispecific proteins as they can be encoded by single cDNA molecule to be easily incorporated into a vector. Further, because the DLL3 targeting trispecific proteins described herein are a monomeric single polypeptide chain, there are no chain pairing issues or a requirement for dimerization. It is contemplated that the DLL3 targeting trispecific proteins described herein have a reduced tendency to aggregate unlike other reported molecules such as bispecific proteins with Fc-gamma immunoglobulin domains.

In the DLL3 targeting trispecific proteins described herein, the domains are, in some embodiments, linked by internal linkers L1 and L2, where L1 links the first and second domain of the DLL3 targeting trispecific proteins and L2 links the second and third domains of the DLL3 targeting trispecific proteins. Linkers L1 and L2 have an optimized length and/or amino acid composition. In some embodiments, linkers L1 and L2 are the same length and amino acid composition. In other embodiments, L1 and L2 are different. In certain embodiments, internal linkers L1 and/or L2 are "short," i.e., consist of 0, 1, 2, 3, 4, 5, 6, 7, 8, 9, 10, 11 or 12 amino acid residues. Thus, in certain instances, the internal linkers consist of about 12 or less amino acid residues. In the case of 0 amino acid residues, the internal linker is a peptide bond. In certain embodiments, internal linkers L1 and/or L2 are "long," i.e., consist of 15, 20 or 25 amino acid residues. In some embodiments, these internal linkers consist of about 3 to about 15, for example 8, 9 or 10 contiguous amino acid residues. Regarding the amino acid composition of the internal linkers L1 and L2, peptides are selected with properties that confer flexibility to the DLL3 targeting trispecific proteins, do not interfere with the binding domains as well as resist cleavage from proteases. For example, glycine and serine residues generally provide protease resistance. Examples of internal linkers suitable for linking the domains in the DLL3 targeting trispecific proteins include but are not limited to $(GS)_n$ (SEQ ID No. 1809), $(GGS)_n$ (SEQ ID No. 1810), $(GGGS)_n$ (SEQ ID No. 1811), $(GGSG)_n$ (SEQ ID No. 1812), $(GGSGG)_n$ (SEQ ID No. 1813), $(GGGGS)_n$ (SEQ ID No. 1814), $(GGGGG)_n$ (SEQ ID No. 1815), or $(GGG)_n$ (SEQ ID No. 1816), wherein n is 1, 2, 3, 4, 5, 6, 7, 8, 9, or 10. In one embodiment, internal linker L1 and/or L2 is $(GGGGS)_4$ (SEQ ID No. 1817) or $(GGGGS)_3$ (SEQ ID No. 1818). In another embodiment, internal linker L1 and/or L2 is GGGGSGGGS (SEQ ID No. 1808).

In some cases, the domains within the DLL3 targeting trispecific protein are conjugated using an enzymatic site-specific conjugation method which involves the use of a mammalian or bacterial transglutaminase enzyme. Microbial transglutaminases (mTGs) are versatile tools in modern research and biotechnology. The availability of large quantities of relatively pure enzymes, ease of use, and lack of regulation by calcium and guanosine-5'-triphosphate (GTP) has propelled mTG to be the main cross-linking enzyme used in both the food industry and biotechnology. Currently, mTGs are used in many applications to attach proteins and peptides to small molecules, polymers, surfaces, DNA, as well as to other proteins. See, Pavel Strp, Veracity of microbial transglutaminase, Bioconjugate Chem. 25, 5, 855-862).

In some examples are provided DLL3 targeting trispecific protein wherein one of the domains comprises an acceptor glutamine in a constant region, which can then be conjugated to another domain via a lysine-based linker (e.g., any primary amine chain which is a substrate for TGase, comprising an alkylamine, oxoamine) wherein the conjugation occurs exclusively on one or more acceptor glutamine residues present in the targeting moiety outside of the antigen combining site (e.g., outside a variable region, in a constant region). Conjugation thus does not occur on a glutamine, an at least partly surface exposed glutamine, within the variable region. The trispecific protein, in some examples, is formed by reacting one of the domains with a lysine-based linker in the presence of a TGase.

In some embodiments, where one or more domains within the DLL3 targeting trispecific binding protein are directly joined, a hybrid vector is made where the DNA encoding the directly joined domains are themselves directly ligated to each other. In some embodiments, where linkers are used, a hybrid vector is made where the DNA encoding a first domain out of the three domains is ligated to the DNA encoding one end of a first linker moiety and the DNA encoding a second domain out of the three domains is ligated to the other end of the first linker moiety; further, the DNA encoding the second domain out of the three domains is linked to one end of a second linker moiety and the DNA encoding a third domain out of the three domains is linked to the other end of the second linker moiety, wherein the first domain, the second domain, and the third domain are distinct and wherein the first domain, the second domain, and the third domain are independently selected from domain A, domain B, and domain C. Such ligation is performed, for example, either in series, or as a three way ligation.

CD3 Binding Domain

The specificity of the response of T cells is mediated by the recognition of antigen (displayed in context of a major histocompatibility complex, WIC) by the TCR. As part of the TCR, CD3 is a protein complex that includes a CD3γ (gamma) chain, a CD3δ (delta) chain, and two CD3ε (epsilon) chains which are present on the cell surface. CD3 associates with the α (alpha) and β (beta) chains of the TCR as well as CD3 ζ (zeta) altogether to comprise the complete TCR. Clustering of CD3 on T cells, such as by immobilized anti-CD3 antibodies leads to T cell activation similar to the engagement of the T cell receptor but independent of its clone-typical specificity.

In one aspect, the DLL3 targeting trispecific proteins described herein comprise a domain which specifically binds to CD3. In one aspect, the DLL3 targeting trispecific proteins described herein comprise a domain which specifically binds to human CD3. In some embodiments, the DLL3 targeting trispecific proteins described herein comprise a domain which specifically binds to CD3γ. In some embodiments, the DLL3 targeting trispecific proteins described herein comprise a domain which specifically binds to CD3δ. In some embodiments, the DLL3 targeting trispecific proteins described herein comprise a domain which specifically binds to CD3ε.

In further embodiments, the DLL3 targeting trispecific proteins described herein comprise a domain which specifically binds to the TCR. In certain instances, the DLL3 targeting trispecific proteins described herein comprise a domain which specifically binds the α chain of the TCR. In certain instances, the DLL3 targeting trispecific proteins described herein comprise a domain which specifically binds the β chain of the TCR.

In certain embodiments, the CD3 binding domain of the DLL3 targeting trispecific proteins described herein exhibit not only potent CD3 binding affinities with human CD3, but show also excellent cross reactivity with the respective cynomolgus monkey CD3 proteins.

In some embodiments, the CD3 binding domain of the DLL3 trispecific antigen-binding protein can be any domain that binds to CD3 including but not limited to domains from a monoclonal antibody, a polyclonal antibody, a recombinant antibody, a human antibody, a humanized antibody. In some instances, it is beneficial for the CD3 binding domain to be derived from the same species in which the DLL3 trispecific antigen-binding protein will ultimately be used in. For example, for use in humans, it may be beneficial for the CD3 binding domain of the DLL3 trispecific antigen-binding protein to comprise human or humanized residues from the antigen binding domain of an antibody or antibody fragment.

Thus, in one aspect, the antigen-binding domain comprises a humanized or human antibody or an antibody fragment, or a murine antibody or antibody fragment. In one embodiment, the humanized or human anti-CD3 binding domain comprises one or more (e.g., all three) light chain complementary determining region 1 (LC CDR1), light chain complementary determining region 2 (LC CDR2), and light chain complementary determining region 3 (LC CDR3) of a humanized or human anti-CD3 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a humanized or human anti-CD3 binding domain described herein, a humanized or human anti-CD3 binding domain comprising one or more, all three, LC CDRs and one or more, all three, HC CDRs.

In some embodiments, the humanized or human anti-CD3 binding domain comprises a humanized or human light chain variable region specific to CD3 where the light chain variable region specific to CD3 comprises human or non-human light chain CDRs in a human light chain framework region. In certain instances, the light chain framework region is a λ (lamda) light chain framework. In other instances, the light chain framework region is a κ (kappa) light chain framework.

In some embodiments, the humanized or human anti-CD3 binding domain comprises a humanized or human heavy chain variable region specific to CD3 where the heavy chain variable region specific to CD3 comprises human or non-human heavy chain CDRs in a human heavy chain framework region.

In certain instances, the complementary determining regions of the heavy chain and/or the light chain are derived from known anti-CD3 antibodies, such as, for example, muromonab-CD3 (OKT3), otelixizumab (TRX4), teplizumab (MGA031), visilizumab (Nuvion), SP34, TR-66 or X35-3, VIT3, BMA030 (BW264/56), CLB-T3/3, CRIS7, YTH12.5, F111-409, CLB-T3.4.2, TR-66, WT32, SPv-T3b, 11D8, XIII-141, XIII-46, XIII-87, 12F6, T3/RW2-8C8, T3/RW2-4B6, OKT3D, M-T301, SMC2, F101.01, UCHT-1 and WT-31.

In one embodiment, the anti-CD3 binding domain is a single chain variable fragment (scFv) comprising a light chain and a heavy chain of an amino acid sequence provided herein. As used herein, "single chain variable fragment" or "scFv" refers to an antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single polypeptide chain, and wherein the scFv retains the specificity of the intact antibody from which it is derived. In an embodiment, the anti-CD3 binding domain comprises: a light chain variable region comprising an amino acid sequence having at least one, two or three modifications (e.g., substitutions) but not more than 30, 20 or 10 modifications (e.g., substitutions) of an amino acid sequence of a light chain variable region provided herein, or a sequence with 95-99% identity with an amino acid sequence provided herein; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided herein, or a sequence with 95-99% identity to an amino acid sequence provided herein. In some examples, the anti-CD3 binding domain comprises a sequence selected from SEQ ID Nos. 1793-1807, or a sequence that is at least about 60%, about 70%, about 75%, about 80%, about 85%, about 90%, about 91%, about 92%, about 93%, about 94%, about 95%, about 96%, about 97%, about 98%, about 99%, or about 100% identity to a sequence selected from SEQ ID Nos. 1793-1807. In some examples, the anti-CD3 binding domain comprises three heavy chain CDRs (HC CDR1, HC CDR2, and HC CDR3), and three light chain CDRs. The heavy chain CDR1(HC CDR1) of the CD3 binding domain comprises a sequence selected from SEQ ID Nos. 1820-1831, or a sequence comprising one or more modifications or substitutions in a sequence selected from SEQ ID Nos. 1820-1831, or at least about 80% to about 99%. The heavy chain CDR2 (HC CDR2) of the CD3 binding domain comprises a sequence selected from SEQ ID Nos. 1832-1841, or a sequence comprising one or more modifications or substitutions in a sequence selected from SEQ ID Nos. 1832-1841. The heavy chain CDR3 (HC CDR3) of the CD3 binding domain comprises a sequence selected from SEQ ID Nos. 1842-1853, or a sequence comprising one or more modifications or substitutions in a sequence selected from SEQ ID Nos. 1842-1853. The light chain CDR1 (LC CDR1) of the CD3 binding domain comprises a sequence selected from SEQ ID Nos. 1852-1864, or a sequence comprising one or more modifications or substitutions in a sequence selected from SEQ ID Nos. 1852-1864. The light chain CDR2 (LC CDR2) of the CD3 binding domain comprises a sequence selected from SEQ ID Nos. 1865-1877, or a sequence comprising one or more modifications or substitutions in a sequence selected from SEQ ID Nos. 1865-1877. The light chain CDR3 (LC CDR3) of the CD3 binding domain comprises a sequence selected from SEQ ID Nos. 1878-1884, or a sequence comprising one or more modifications or substitutions in a sequence selected from SEQ ID Nos. 1878-1884. In one embodiment, the humanized or human anti-CD3 binding domain is a scFv, and a light chain variable region comprising an amino acid sequence described herein, is attached to a heavy chain variable region comprising an amino acid sequence described herein, via a scFv linker. The light chain variable region and heavy chain variable region of a scFv can be in any of the following orientations: light chain variable region-scFv linker-heavy chain variable region or heavy chain variable region-scFv linker-light chain variable region.

In some instances, scFvs which bind to CD3 are prepared according to known methods. For example, scFv molecules can be produced by linking VH and VL regions together using flexible polypeptide linkers. The scFv molecules comprise a scFv linker (e.g., a Ser-Gly linker) with an optimized length and/or amino acid composition. Accordingly, in some embodiments, the length of the scFv linker is such that the VH or VL domain can associate intermolecularly with the other variable domain to form the CD3 binding site. In certain embodiments, such scFv linkers are "short", i.e. consist of 0, 1, 2, 3, 4, 5, 6, 7, 8, 9, 10, 11 or 12 amino acid residues. Thus, in certain instances, the scFv linkers consist of about 12 or less amino acid residues. In the case of 0 amino acid residues, the scFv linker is a peptide bond. In some embodiments, these scFv linkers consist of about 3 to about 15, for example 8, 9 or 10 contiguous amino acid residues. Regarding the amino acid composition of the scFv linkers, peptides are selected that confer flexibility, do not interfere with the variable domains as well as allow interchain folding to bring the two variable domains together to form a functional CD3 binding site. For example, scFv linkers comprising glycine and serine residues generally provide protease resistance. In some embodiments, linkers in a scFv comprise glycine and serine residues. The amino acid sequence of the scFv linkers can be optimized, for example, by phage-display methods to improve the CD3 binding and production yield of the scFv. Examples of peptide scFv linkers suitable for linking a variable light domain and a variable heavy domain in a scFv include but are not limited to $(GS)_n$ (SEQ ID No. 1809), $(GGS)_n$ (SEQ ID No. 1810), $(GGGS)_n$ (SEQ ID No. 1811), $(GGSG)_n$ (SEQ ID No. 1812), $(GGSGG)_n$ (SEQ ID No. 1813), $(GGGGS)_n$ (SEQ ID No. 1814), $(GGGGG)_n$ (SEQ ID No. 1815), or $(GGG)_n$ (SEQ ID No. 1816), wherein n is 1, 2, 3, 4, 5, 6, 7, 8, 9, or 10. In one embodiment, the scFv linker can be $(GGGGS)_4$ (SEQ ID No. 1817) or $(GGGGS)_3$ (SEQ ID No. 1818). In some embodiments, a linker comprises a sequence composed of any combinations of the linkers as set forth in SEQ ID Nos. 1809 to 1818, and the length of such a linker is in some examples up to 15 amino acids, or longer than 15 amino acids. Variation in the linker length may retain or enhance activity, giving rise to superior efficacy in activity studies.

In some embodiments, CD3 binding domain of DLL3 targeting trispecific antigen-binding protein has an affinity to CD3 on CD3 expressing cells with a $K_D$ of 1000 nM or less, 500 nM or less, 200 nM or less, 100 nM or less, 80 nM or less, 50 nM or less, 20 nM or less, 10 nM or less, 5 nM or less, 1 nM or less, or 0.5 nM or less. In some embodiments, the CD3 binding domain of DLL3 targeting trispecific antigen-binding protein has an affinity to CD3ε, γ, or δ with a $K_D$ of 1000 nM or less, 500 nM or less, 200 nM or less, 100 nM or less, 80 nM or less, 50 nM or less, 20 nM or less, 10 nM or less, 5 nM or less, 1 nM or less, or 0.5 nM or less. In further embodiments, CD3 binding domain of DLL3 targeting trispecific antigen-binding protein has low affinity to CD3, i.e., about 100 nM or greater.

The affinity to bind to CD3 can be determined, for example, by the ability of the DLL3 targeting trispecific antigen-binding protein itself or its CD3 binding domain to bind to CD3 coated on an assay plate; displayed on a microbial cell surface; in solution; etc. The binding activity of the DLL3 targeting trispecific antigen-binding protein itself or its CD3 binding domain of the present disclosure to CD3 can be assayed by immobilizing the ligand (e.g., CD3) or the DLL3 targeting trispecific antigen-binding protein itself or its CD3 binding domain, to a bead, substrate, cell, etc. Agents can be added in an appropriate buffer and the binding partners incubated for a period of time at a given temperature. After washes to remove unbound material, the bound protein can be released with, for example, SDS, buffers with a high pH, and the like and analyzed, for example, by Surface Plasmon Resonance (SPR).

Half-Life Extension Domain

Contemplated herein are domains which extend the half-life of an antigen-binding domain. Such domains are contemplated to include but are not limited to Albumin binding domains, Fc domains, small molecules, and other half-life extension domains known in the art.

Human albumin (ALB) (molecular mass 67 kDa) is the most abundant protein in plasma, present at about 50 mg/ml (600 μM), and has a half-life of around 20 days in humans. ALB serves to maintain plasma pH, contributes to colloidal blood pressure, functions as carrier of many metabolites and fatty acids, and serves as a major drug transport protein in plasma.

Noncovalent association with albumin extends the elimination half-time of short lived proteins. For example, a recombinant fusion of an albumin binding domain to a Fab fragment resulted in an in vivo clearance of 25- and 58-fold and a half-life extension of 26- and 37-fold when administered intravenously to mice and rabbits respectively as compared to the administration of the Fab fragment alone. In another example, when insulin is acylated with fatty acids to promote association with albumin, a protracted effect was observed when injected subcutaneously in rabbits or pigs. Together, these studies demonstrate a linkage between albumin binding and prolonged action.

In one aspect, the DLL3 targeting trispecific proteins described herein comprise a half-life extension domain, for example a domain which specifically binds to ALB. In some embodiments, the ALB binding domain of the DLL3 targeting trispecific antigen-binding protein can be any domain that binds to ALB including but not limited to domains from a monoclonal antibody, a polyclonal antibody, a recombinant antibody, a human antibody, a humanized antibody. In some embodiments, the ALB binding domain is a single chain variable fragments (scFv), single-domain antibody such as a heavy chain variable domain (VH), a light chain variable domain (VL) and a variable domain (VHH) of camelid derived single domain antibody, peptide, ligand or small molecule entity specific for HSA. In certain embodiments, the ALB binding domain is a single-domain antibody. In other embodiments, the HSA binding domain is a peptide. In further embodiments, the HSA binding domain is a small molecule. It is contemplated that the HSA binding domain of DLL3 trispecific antigen-binding protein is fairly small and no more than 25 kD, no more than 20 kDa, no more than 15 kDa, or no more than 10 kDa in some embodiments. In certain instances, the ALB binding is 5 kDa or less if it is a peptide or small molecule entity.

The half-life extension domain of DLL3 targeting trispecific antigen-binding protein provides for altered pharmacodynamics and pharmacokinetics of the DLL3 targeting trispecific antigen-binding protein itself. As above, the half-life extension domain extends the elimination half-time. The half-life extension domain also alters pharmacodynamic properties including alteration of tissue distribution, penetration, and diffusion of the trispecific antigen-binding protein. In some embodiments, the half-life extension domain provides for improved tissue (including tumor) targeting, tissue distribution, tissue penetration, diffusion within the tissue, and enhanced efficacy as compared with a protein without a half-life extension domain. In one embodiment, therapeutic methods effectively and efficiently utilize a reduced amount of the trispecific antigen-binding protein, resulting in reduced side effects, such as reduced non-tumor cell cytotoxicity.

Further, the binding affinity of the half-life extension domain can be selected so as to target a specific elimination half-time in a particular trispecific antigen-binding protein. Thus, in some embodiments, the half-life extension domain has a high binding affinity. In other embodiments, the half-life extension domain has a medium binding affinity. In yet other embodiments, the half-life extension domain has a low or marginal binding affinity. Exemplary binding affinities include KD concentrations at 10 nM or less (high), between 10 nM and 100 nM (medium), and greater than 100 nM (low). As above, binding affinities to ALB are determined by known methods such as Surface Plasmon Resonance (SPR). In some embodiments, ALB binding domains described herein comprise a single domain antibody.

In some embodiments, the half-life extension domain comprises a sequence selected from SEQ ID Nos. 1769-1778, or a sequence that is at least about 70%, about 75%, about 80%, about 85%, about 90%, about 95%, about 96%, about 97%, about 98%, about 99%, or 100% identical to a sequence selected from SEQ ID Nos. 1769-1778. In some examples, the half-life extension comprises three heavy chain CDRs (HC CDR1, HC CDR2, and HC CDR3), and three light chain CDRs. In some examples, the half-life extension comprises three heavy chain CDRs (HC CDR1, HC CDR2, and HC CDR3), or three light chain CDRs. The heavy chain CDR1(HC CDR1) of the half-life extension domain, in some embodiments, comprises a sequence selected from SEQ ID Nos. 1782-1784, or a sequence comprising one or more modifications or substitutions in a sequence selected from SEQ ID Nos. 1782-1784, or at least about 80% to about 99%. The heavy chain CDR2 (HC CDR2) of the half-life extension domain, in some embodiments, comprises a sequence selected from SEQ ID Nos. 1785-1790, or a sequence comprising one or more modifications or substitutions in a sequence selected from SEQ ID Nos. 1785-1790. The heavy chain CDR3 (HC CDR3) of the CD3 binding domain comprises a sequence selected from SEQ ID Nos. 1791 or 1792, or a sequence comprising one or more modifications or substitutions in a sequence selected from SEQ ID Nos. 1791 or 1792.

DLL3 Binding Domain

DLL3 (also known as Delta-like Ligand 3 or SCDO1) is a member of the Delta-like family of Notch DSL ligands. Representative DLL3 protein orthologs include, but are not limited to, human (Accession Nos. NP_058637 and NP_982353), chimpanzee (Accession No. XP_003316395), mouse (Accession No. NP_031892), and rat (Accession No. NP_446118). In humans, the DLL3 gene consists of 8 exons spanning 9.5 kbp located on chromosome 19q13. Alternate splicing within the last exon gives rise to two processed transcripts, one of 2389 bases (Accession No. NM_016941) and one of 2052 bases (Accession No. NM 203486). The former transcript encodes a 618 amino acid protein (Accession No. NP_058637), whereas the latter encodes a 587 amino acid protein (Accession No. NP_982353). These two protein isoforms of DLL3 share overall 100% identity across their extracellular domains and their transmembrane domains, differing only in that the longer isoform contains an extended cytoplasmic tail containing 32 additional residues at the carboxy terminus of the protein. The extracellular region of the DLL3 protein, comprises six EGF-like domains, the single DSL domain and the N-terminal domain. Generally, the EGF domains are recognized as occurring at about amino acid residues 216-249 (domain 1), 274-310 (domain 2), 312-351 (domain 3), 353-389 (domain 4), 391-427 (domain 5) and 429-465 (domain 6), with the DSL domain at about amino acid residues 176-215 and the N-terminal domain at about amino acid residues 27-175 of hDLL3. Each of the EGF-like domains, the DSL domain and the N-terminal domain comprise part of the DLL3 protein as defined by a distinct amino acid sequence. The EGF-like domains are termed, in some embodiments, as EGF1 to EGF6 with EGF1 being closest to the N-terminal portion of the protein. In general, DSL ligands are composed of a series of structural domains: a unique N-terminal domain, followed by a conserved DSL domain, multiple tandem epidermal growth factor (EGF)-like repeats, a transmembrane domain, and a cytoplasmic domain not highly conserved across ligands but one which contains multiple lysine residues that are potential sites for ubiquitination by unique E3 ubiquitin ligases. The DSL domain is a degenerate EGF-domain that is necessary but not sufficient for interactions with Notch receptors. Additionally, the first two EGF-like repeats of most DSL ligands contain a smaller protein sequence motif known as a DOS domain that co-operatively interacts with the DSL domain when activating Notch signaling.

In some embodiments, the disclosed DLL3 trispecific binding proteins of this disclosure are generated, fabricated, engineered or selected so as to react with a selected domain, motif or epitope within a DLL3 protein. In some embodiments, the DLL3 targeting trispecific protein binds to the DSL domain and, in some embodiments, binds to an epitope comprising G203, R205, P206 within the DSL domain.

The DLL3 binding domain of the DLL3 targeting trispecific proteins of the present disclosure are, in some embodiments, engineered fabricated and/or selected to react with both isoform(s) of DLL3 or a single isoform of the protein or, conversely, comprise a pan-DLL binding domain that reacts or associates with at least one additional DLL family member in addition to DLL3. In some embodiments, the DLL3 binding domain, such as DLL3 binding domain are engineered, fabricated, and/or selected so that they react with domains (or epitopes therein) that are exhibited by DLL3 only or with domains that are at least somewhat conserved across multiple or all DLL family members.

In some embodiments the DLL3 binding domain associates or binds to a specific epitope, portion, motif or domain of DLL3. Both DLL3 isoforms incorporate an identical extracellular region comprising at least an N-terminal domain, a DSL (Delta/Serrate/lag-2) domain and six EGF-like domains (i.e., EGF1-EGF6). Accordingly, in certain embodiments the DLL3 binding domain binds or associate with the N-terminal domain of DLL3 (amino acids 27-175 in the mature protein) while in other embodiments the DLL3 binding domain associates with the DSL domain (amino acids 176-215) or epitope therein. In other aspects of the present disclosure the DLL3 binding domain associates or bind to a specific epitope located in a particular EGF-like domain of DLL3. In some embodiments, the DLL3 binding domain associates or binds to an epitope located in EGF1 (amino acids 216-249), EGF2 (amino acids 274-310), EGF3 (amino acids 312-351), EGF4 (amino acids 353-389), EGF2 (amino acids 391.427) or EGF6 (amino acids 429-465). In some embodiments, each of the aforementioned domains comprises more than one epitope and/or more than one bin. In some embodiments the DLL3 binding domain binds, reacts or associates with the DSL domain or an epitope therein. In other embodiments the DLL3 binding domain binds, reacts or associates with a particular EGF-like domain or an epitope therein. In some embodiments the DLL3 binding domain binds, reacts or associates with the N-terminal domain or an epitope therein.

In some embodiments, the DLL3 binding proteins of this disclosure, such as the DLL3 binding domain of the trispecific proteins of this disclosure binds to the full length DLL3 protein or to a fragment thereof, such as epitope containing fragments within the full length DLL3 protein, as described above. In some cases, the epitope containing fragment comprises antigenic or immunogenic fragments and derivatives thereof of the DLL3 protein. Epitope containing fragments, including antigenic or immunogenic fragments, are, in some embodiments, 12 amino acids or more, 20 amino acids or more, 50 or 100 amino acids or more. The DLL3 fragments, in some embodiments, comprises 95% or more of the length of the full protein, 90% or more, 75% or 50% or 25% or 10% or more of the length of the full protein. In some embodiments, the epitope-containing fragments of DLL3 including antigenic or immunogenic fragments are capable of eliciting a relevant immune response in a patient. Derivatives of DLL3 include, in some embodiments, variants on the sequence in which one or more (e.g., 1-20 such as 15 amino acids, or up to 20% such as up to 10% or 5% or 1% by number of amino acids based on the total length of the protein) deletions, insertions or substitutions have been made to the DLL3 sequence provided in SEQ ID No. 1885 (UniProtKB Accession Q9NYJ7). In some embodiments, substitutions comprise conservative substitutions. Derivatives and variants of DLL3, in some examples, have essentially the same biological function as the DLL3 protein from which they are derived. For instance, derivatives and variants of DLL3 are, in some cases, comparably antigenic or immunogenic to the protein from which they are derived, have either the ligand-binding activity, or the active receptor-complex forming ability, or preferably both, of the protein from which they are derived, and have the same tissue distribution as DLL3.

The design of the DLL3 targeting trispecific proteins described herein allows the binding domain to DLL3 to be flexible in that the binding domain to DLL3 can be any type of binding domain, including but not limited to, domains from a monoclonal antibody, a polyclonal antibody, a recombinant antibody, a human antibody, a humanized antibody. In some embodiments, the binding domain to DLL3 is a single chain variable fragments (scFv), a single-domain antibody such as a heavy chain variable domain (VH), a light chain variable domain (VL) and a variable domain (VHH) of camelid derived single domain antibody. In other embodiments, the binding domain to DLL3 is a non-Ig binding domain, i.e., an antibody mimetic, such as anticalins, affilins, affibody molecules, affimers, affitins, alphabodies, avimers, DARPins, fynomers, kunitz domain peptides, and monobodies. In further embodiments, the binding domain to DLL3 is a ligand or peptide that binds to or associates with DLL3. In yet further embodiments, the binding domain to DLL3 is a knottin. In yet further embodiments, the binding domain to DLL3 is a small molecular entity.

In some embodiments, the DLL3 binding domain binds to a protein comprising the sequence of SEQ ID No. 1885 (UniProtKB Accession Q9NYJ7). In some embodiments, the DLL3 binding domain binds to a protein comprising a truncated sequence compared to SEQ ID No. 1885 (UniProtKB Accession Q9NYJ7). In some embodiments, the DLL3 binding domain binds to a protein comprising the sequence of SEQ ID No. 1892 or SEQ ID No. 1893 (which is the mature extracellular domain of a DLL3 protein). In some embodiments, the DLL3 binding domain binds to a protein comprising amino acids 47-492 of SEQ ID No. 1892. In some embodiments, the DLL3 binding domain recognizes an epitope within amino acids 47-4492 of SEQ ID No. 1892.

In some embodiments, the DLL3 binding domain is an anti-DLL3 antibody or an antibody variant. As used herein, the term "antibody variant" refers to variants and derivatives of an antibody described herein. In certain embodiments, amino acid sequence variants of the anti-DLL3 antibodies described herein are contemplated. For example, in certain embodiments amino acid sequence variants of anti-DLL3 antibodies described herein are contemplated to improve the binding affinity and/or other biological properties of the antibodies. Exemplary method for preparing amino acid variants include, but are not limited to, introducing appropriate modifications into the nucleotide sequence encoding the antibody, or by peptide synthesis. Such modifications include, for example, deletions from, and/or insertions into and/or substitutions of residues within the amino acid sequences of the antibody.

Any combination of deletion, insertion, and substitution can be made to arrive at the final construct, provided that the final construct possesses the desired characteristics, antigen-binding. In certain embodiments, antibody variants having one or more amino acid substitutions are provided. Sites of interest for substitution mutagenesis include the CDRs and framework regions. Examples of such substitutions are described below. Amino acid substitutions may be introduced into an antibody of interest and the products screened for a desired activity, retained/improved antigen binding, decreased immunogenicity, or improved T-cell mediated cytotoxicity (TDCC). Both conservative and non-conservative amino acid substitutions are contemplated for preparing the antibody variants.

In another example of a substitution to create a variant anti-DLL3 antibody, one or more hypervariable region residues of a parent antibody are substituted. In general, variants are then selected based on improvements in desired properties compared to a parent antibody, for example, increased affinity, reduced affinity, reduced immunogenicity, increased pH dependence of binding.

In some embodiments, the DLL3 binding domain of the DLL3 targeting trispecific protein is a single domain antibody such as a heavy chain variable domain (VH), a variable domain (VHH) of a llama derived sdAb, a peptide, a ligand or a small molecule entity specific for DLL3. In some embodiments, the DLL3 binding domain of the DLL3 targeting trispecific protein described herein is any domain that binds to DLL3 including but not limited to domains from a monoclonal antibody, a polyclonal antibody, a recombinant antibody, a human antibody, a humanized antibody. In certain embodiments, the DLL3 binding domain is a single-domain antibody. In other embodiments, the DLL3 binding domain is a peptide. In further embodiments, the DLL3 binding domain is a small molecule.

Generally, it should be noted that the term single domain antibody as used herein in its broadest sense is not limited to a specific biological source or to a specific method of preparation. Single domain antibodies are antibodies whose complementary determining regions are part of a single domain polypeptide. Examples include, but are not limited to, heavy chain antibodies, antibodies naturally devoid of light chains, single domain antibodies derived from conventional 4-chain antibodies, engineered antibodies and single domain scaffolds other than those derived from antibodies. Single domain antibodies may be any of the art, or any future single domain antibodies. Single domain antibodies may be derived from any species including, but not limited to mouse, human, camel, llama, goat, rabbit, bovine. For example, in some embodiments, the single domain antibodies of the disclosure are obtained: (1) by isolating the VHH domain of a naturally occurring heavy chain antibody; (2) by expression of a nucleotide sequence encoding a naturally occurring VHH domain; (3) by "humanization" of a naturally occurring VHH domain or by expression of a nucleic acid encoding a such humanized VHH domain; (4) by "camelization" of a naturally occurring VH domain from any animal species, and in particular from a species of mammal, such as from a human being, or by expression of a nucleic acid encoding such a camelized VH domain; (5) by "camelisation" of a "domain antibody" or "Dab," or by expression of a nucleic acid encoding such a camelized VH domain; (6) by using synthetic or semi-synthetic techniques for preparing proteins, polypeptides or other amino acid sequences; (7) by preparing a nucleic acid encoding a single domain antibody using techniques for nucleic acid synthesis known in the field, followed by expression of the nucleic acid thus obtained; and/or (8) by any combination of one or more of the foregoing.

In one embodiment, a single domain antibody corresponds to the VHH domains of naturally occurring heavy chain antibodies directed against DLL3. As further described herein, such VHH sequences can generally be generated or obtained by suitably immunizing a species of Llama with DLL3, (i.e., so as to raise an immune response and/or heavy chain antibodies directed against DLL3), by obtaining a suitable biological sample from said Llama (such as a blood sample, serum sample or sample of B-cells), and by generating VHH sequences directed against DLL3, starting from said sample, using any suitable technique known in the field.

In another embodiment, such naturally occurring VHH domains against DLL3, are obtained from naïve libraries of Camelid VHH sequences, for example by screening such a library using DLL3, or at least one part, fragment, antigenic determinant or epitope thereof using one or more screening techniques known in the field. Such libraries and techniques are for example described in WO 99/37681, WO 01/90190, WO 03/025020 and WO 03/035694. Alternatively, improved synthetic or semi-synthetic libraries derived from naïve VHH libraries are used, such as VHH libraries obtained from naïve VHH libraries by techniques such as random mutagenesis and/or CDR shuffling, as for example described in WO 00/43507.

In a further embodiment, yet another technique for obtaining VHH sequences directed against DLL3, involves suitably immunizing a transgenic mammal that is capable of expressing heavy chain antibodies (i.e., so as to raise an immune response and/or heavy chain antibodies directed against DLL3), obtaining a suitable biological sample from said transgenic mammal (such as a blood sample, serum sample or sample of B-cells), and then generating VHH sequences directed against DLL3, starting from said sample, using any suitable technique known in the field. For example, for this purpose, the heavy chain antibody-expressing rats or mice and the further methods and techniques described in WO 02/085945 and in WO 04/049794 can be used.

In some embodiments, an anti-DLL3 single domain antibody of the DLL3 targeting trispecific protein comprises a single domain antibody with an amino acid sequence that corresponds to the amino acid sequence of a naturally occurring VHH domain, but that has been "humanized", i.e., by replacing one or more amino acid residues in the amino acid sequence of said naturally occurring VHH sequence (and in particular in the framework sequences) by one or more of the amino acid residues that occur at the corresponding position(s) in a VH domain from a conventional 4-chain antibody from a human being (e.g., as indicated above). This can be performed in a manner known in the field, which will be clear to the skilled person, for example on the basis of the further description herein. Again, it should be noted that such humanized anti-DLL3 single domain antibodies of the disclosure are obtained in any suitable manner known per se (i.e., as indicated under points (1)-(8) above) and thus are not strictly limited to polypeptides that have been obtained using a polypeptide that comprises a naturally occurring VHH domain as a starting material. In some additional embodiments, a single domain anti-DLL3 antibody, as described herein, comprises a single domain antibody with an amino acid sequence that corresponds to the amino acid sequence of a naturally occurring VH domain, but that has been "camelized," i.e., by replacing one or more amino acid residues in the amino acid sequence of a naturally occurring VH domain from a conventional 4-chain antibody by one or more of the amino acid residues that occur at the corresponding position(s) in a VHH domain of a heavy chain antibody. Such "camelizing" substitutions are preferably inserted at amino acid positions that form and/or are present at the VH-VL interface, and/or at the so-called Camelidae hallmark residues (see for example WO 94/04678 and Davies and Riechmann (1994 and 1996)). Preferably, the VH sequence that is used as a starting material or starting point for generating or designing the camelized single domain is preferably a VH sequence from a mammal, more preferably the VH sequence of a human being, such as a VH3 sequence. However, it should be noted that such camelized anti-DLL3 single domain antibodies of the disclosure, in certain embodiments, are obtained in any suitable manner known in the field (i.e., as indicated under points (1)-(8) above) and thus are not strictly limited to polypeptides that have been obtained using a polypeptide that comprises a naturally occurring VH domain as a starting material. For example, as further described herein, both "humanization" and "camelization" is performed by providing a nucleotide sequence that encodes a naturally occurring VHH domain or VH domain, respectively, and then changing, one or more codons in said nucleotide sequence in such a way that the new nucleotide sequence encodes a "humanized" or "camelized" single domain antibody, respectively. This nucleic acid can then be expressed, so as to provide a desired anti-DLL3 single domain antibody of the disclosure. Alternatively, in other embodiments, based on the amino acid sequence of a naturally occurring VHH domain or VH domain, respectively, the amino acid sequence of the desired humanized or camelized anti-DLL3 single domain antibody of the disclosure, respectively, are designed and then synthesized de novo using known techniques for peptide synthesis. In some embodiments, based on the amino acid sequence or nucleotide sequence of a naturally occurring VHH domain or VH domain, respectively, a nucleotide sequence encoding the desired humanized or camelized anti-DLL3 single domain antibody of the disclosure, respectively, is designed and then synthesized de novo using known techniques for nucleic acid synthesis, after which the nucleic acid thus obtained is expressed in using known expression techniques, so as to provide the desired anti-DLL3 single domain antibody of the disclosure.

Other suitable methods and techniques for obtaining the anti-DLL3 single domain antibody of the disclosure and/or nucleic acids encoding the same, starting from naturally occurring VH sequences or VHH sequences for example comprises combining one or more parts of one or more naturally occurring VH sequences (such as one or more framework (FR) sequences and/or complementarity determining region (CDR) sequences), one or more parts of one or more naturally occurring VHH sequences (such as one or more FR sequences or CDR sequences), and/or one or more synthetic or semi-synthetic sequences, in a suitable manner, so as to provide an anti-DLL3 single domain antibody of the disclosure or a nucleotide sequence or nucleic acid encoding the same.

In some embodiments, the DLL3 binding domain is an anti-DLL3 specific antibody comprising a heavy chain variable complementarity determining region CDR1, a heavy chain variable CDR2, a heavy chain variable CDR3, a light chain variable CDR1, a light chain variable CDR2, and a light chain variable CDR3. In some embodiments, the DLL3 binding domain comprises any domain that binds to DLL3 including but not limited to domains from a monoclonal antibody, a polyclonal antibody, a recombinant antibody, a human antibody, a humanized antibody, or antigen binding fragments such as single domain antibodies (sdAb), Fab, Fab', F(ab)2, and Fv fragments, fragments comprised of one or more CDRs, single-chain antibodies (e.g., single chain Fv fragments (scFv)), disulfide stabilized (dsFv) Fv fragments, heteroconjugate antibodies (e.g., bispecific antibodies), pFv fragments, heavy chain monomers or dimers, light chain monomers or dimers, and dimers consisting of one heavy chain and one light chain. In some embodiments, the DLL3 binding domain is a single domain antibody. In some embodiments, the anti-DLL3 single domain antibody comprises heavy chain variable complementarity determining regions (CDR), CDR1, CDR2, and CDR3.

In some embodiments, the DLL3 binding domain is a polypeptide comprising an amino acid sequence that is comprised of four framework regions/sequences (f1-f4) interrupted by three complementarity determining regions/sequences, as represented by the formula: f1-r1-f2-r2-f3-r3-f4, wherein r1, r2, and r3 are complementarity determining regions CDR1, CDR2, and CDR3, respectively, and f1, f2, f3, and f4 are framework residues. The framework residues of the DLL3 binding protein of the present disclosure comprise, for example, 75, 76, 77, 78, 79, 80, 81, 82, 83, 84, 85, 86, 87, 88, 89, 90, 91, 92, 93, or 94 amino acid residues, and the complementarity determining regions comprise, for example, 24, 25, 26, 27, 28, 29, 30, 31, 32, 33, 34, 35, or 36 amino acid residues. In some embodiments, the DLL3 binding domain comprises an amino acid sequence selected from SEQ ID Nos. 1-442 and 1886. In some embodiments, CDR1 of the DLL3 binding domain comprises a sequence selected from SEQ ID Nos. 443-884 and 1887, or one or more amino acid substitutions relative to a sequence selected from the group consisting of SEQ ID Nos. 443-884 and 1887. In some embodiments, CDR2 comprises a sequence selected from the group consisting of SEQ ID Nos. 885-1326 and 1888, or one or more amino acid substitutions relative to a sequence selected from the group consisting of SEQ ID Nos. 885-1326 and 1888. In some embodiments, the CDR3 comprises a sequence selected from the group consisting of SEQ ID Nos. 1327-1768 and 1889, or one or more substitutions relative to a sequence selected from SEQ ID Nos. 1327-1768 and 1889.

In some embodiments, the CDR1 comprises an amino acid sequence selected from SEQ ID Nos. 443-884 and 1887 or a variant having one, two, three, four, five, six, seven, eight, nine, or ten amino acid substitutions in an amino acid selected from SEQ ID Nos. 443-884 and 1887. In some embodiments, the CDR2 comprises an amino acid sequence selected from SEQ ID Nos. 885-1326 and 1888 or a variant having one, two, three, four, five, six, seven, eight, nine, or ten amino acid substitutions in an amino acid sequence selected from SEQ ID Nos. 885-1326 and 1888. In some embodiments, the CDR3 comprises an amino acid sequence selected from SEQ ID Nos. 1327-1768 and 1889 or a variant having one, two, three, four, five, six, seven, eight, nine, or ten amino acid substitutions in a sequence selected from SEQ ID Nos. 1327-1768 and 1889.

In some embodiments, the CDR1 comprises an amino acid sequence selected from SEQ ID Nos. 495-528 or a variant having one, two, three, four, five, six, seven, eight, nine, or ten amino acid substitutions in an amino acid selected from SEQ ID Nos. 495-528. In some embodiments, the CDR2 comprises an amino acid sequence selected from SEQ ID Nos. 937-970 or a variant having one, two, three, four, five, six, seven, eight, nine, or ten amino acid substitutions in an amino acid sequence selected from SEQ ID Nos. 937-970. In some embodiments, the CDR3 comprises an amino acid sequence selected from SEQ ID Nos. 1379-1412 or a variant having one, two, three, four, five, six, seven, eight, nine, or ten amino acid substitutions in a sequence selected from SEQ ID Nos. 1379-1412.

In some embodiments, the CDR1 comprises an amino acid sequence selected from SEQ ID Nos. 529-809 or a variant having one, two, three, four, five, six, seven, eight, nine, or ten amino acid substitutions in an amino acid selected from SEQ ID Nos. 529-809. In some embodiments, the CDR2 comprises an amino acid sequence selected from SEQ ID Nos. 971 to 1251 or a variant having one, two, three, four, five, six, seven, eight, nine, or ten amino acid substitutions in an amino acid sequence selected from SEQ ID Nos. 971 to 1251. In some embodiments, the CDR3 comprises an amino acid sequence selected from SEQ ID Nos. 1379 to 1412 or a variant having one, two, three, four, five, six, seven, eight, nine, or ten amino acid substitutions in a sequence selected from SEQ ID Nos. 1379-1412.

In some embodiments, the CDR1 comprises an amino acid sequence selected from SEQ ID Nos. 810-884 or a variant having one, two, three, four, five, six, seven, eight, nine, or ten amino acid substitutions in an amino acid selected from SEQ ID Nos. 810-884. In some embodiments, the CDR2 comprises an amino acid sequence selected from SEQ ID Nos. 1252 to 1326 or a variant having one, two, three, four, five, six, seven, eight, nine, or ten amino acid substitutions in an amino acid sequence selected from SEQ ID Nos. 1252 to 1326. In some embodiments, the CDR3 comprises an amino acid sequence selected from SEQ ID Nos. 1692 to 1768 or a variant having one, two, three, four, five, six, seven, eight, nine, or ten amino acid substitutions in a sequence selected from SEQ ID Nos. 1692 to 1768.

In various embodiments, the DLL3 binding domain of the present disclosure is at least about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to an amino acid sequence selected from SEQ ID Nos. 1-442 and 1886. In various embodiments, the DLL3 binding domain of the present disclosure is at least about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to an amino acid sequence selected from SEQ ID Nos. 53-86.

In various embodiments, the DLL3 binding domain of the present disclosure is at least about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to an amino acid sequence selected from SEQ ID Nos. 87-367.

In various embodiments, the DLL3 binding domain of the present disclosure is at least about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to SEQ ID No.68, or a sequence derived from SEQ ID No.68.

In various embodiments, the DLL3 binding domain of the present disclosure is at least about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical to SEQ ID No.75, or a sequence derived from SEQ ID No.75.

In some embodiments, the DLL3 binding domain of the DLL3 targeting trispecific binding protein is cross-reactive with human and cynomolgus DLL3. In some embodiments, the DLL3 binding domain is specific for human DLL3. In certain embodiments, the DLL3 binding domain disclosed herein binds to human DLL3 with a human Kd (hKd). In certain embodiments, the DLL3 binding domain disclosed herein binds to cynomolgus DLL3 with a cynomolgus Kd (cKd). In certain embodiments, the DLL3 binding domain disclosed herein binds to both cynomolgus DLL3 and a human DLL3, with a cyno Kd (cKd) and a human Kd, respectively (hKd). In some embodiments, the DLL3 binding protein binds to human and cynomolgus DLL3 with comparable binding affinities (i.e., hKd and cKd values do not differ by more than ±10%). In some embodiments, the hKd and the cKd range from about 0.001 nM to about 500 nM. In some embodiments, the hKd and the cKd range from about 0.001 nM to about 450 nM. In some embodiments, the hKd and the cKd range from about 0.001 nM to about 400 nM. In some embodiments, the hKd and the cKd range from about 0.001 nM to about 350 nM. In some embodiments, the hKd and the cKd range from about 0.001 nM to about 300 nM. In some embodiments, the hKd and the cKd range from about 0.001 nM to about 250 nM. In some embodiments, the hKd and the cKd range from about 0.001 nM to about 200 nM. In some embodiments, the hKd and the cKd range from about 0.001 nM to about 150 nM. In some embodiments, the hKd and the cKd range from about 0.001 nM to about 100 nM. In some embodiments, the hKd and the cKd range from about 0.1 nM to about 90 nM. In some embodiments, the hKd and the cKd range from about 0.2 nM to about 80 nM. In some embodiments, the hKd and the cKd range from about 0.3 nM to about 70 nM. In some embodiments, the hKd and the cKd range from about 0.4 nM to about 50 nM. In some embodiments, the hKd and the cKd range from about 0.5 nM to about 30 nM. In some embodiments, the hKd and the cKd range from about 0.6 nM to about 10 nM. In some embodiments, the hKd and the cKd range from about 0.7 nM to about 8 nM. In some embodiments, the hKd and the cKd range from about 0.8 nM to about 6 nM. In some embodiments, the hKd and the cKd range from about 0.9 nM to about 4 nM. In some embodiments, the hKd and the cKd range from about 1 nM to about 2 nM.

In certain embodiments, the DLL3 binding domains of the present disclosure preferentially bind membrane bound DLL3 over soluble DLL3. Membrane bound DLL3 refers to the presence of DLL3 in or on the cell membrane surface of a cell that expresses DLL3. Soluble DLL3 refers to DLL3 that is no longer on in or on the cell membrane surface of a cell that expresses or expressed DLL3. In certain instances, the soluble DLL3 is present in the blood and/or lymphatic circulation in a subject. In one embodiment, the DLL3 binding proteins bind membrane-bound DLL3 at least 5 fold, 10 fold, 15 fold, 20 fold, 25 fold, 30 fold, 40 fold, 50 fold, 100 fold, 500 fold, or 1000 fold greater than soluble DLL3. In one embodiment, the antigen binding proteins of the present disclosure preferentially bind membrane-bound DLL3 30 fold greater than soluble DLL3. Determining the preferential binding of an antigen binding protein to membrane bound DLL3 over soluble DLL3 can be readily determined using assays well known in the art.

In some embodiments, any of the foregoing DLL3 binding domains (e.g., anti-DLL3 single domain antibodies of SEQ ID Nos. 1-442 and 1886) are affinity peptide tagged for ease of purification. In some embodiments, the affinity peptide tag is six consecutive histidine residues, also referred to as 6X-his (SEQ ID No. 1819).

In some embodiments, any of the foregoing DLL3 binding domains (e.g., anti-DLL3 single domain antibodies of SEQ ID Nos. 1-442 and 1886) are affinity peptide tagged for ease of purification. In some embodiments, the affinity peptide tag is six consecutive histidine residues, also referred to as 6X-his (SEQ ID No. 1819).

Integration into Chimeric Antigen Receptors (CAR)

The DLL3 targeting trispecific antigen binding proteins of the present disclosure can, in certain examples, be incorporated into a chimeric antigen receptor (CAR). An engineered immune effector cell, a T cell or NK cell, can be used to express a CAR that includes an anti-DLL3 targeting trispecific protein containing an anti-DLL3 single domain antibody as described herein. In one embodiment, the CAR including an anti-DLL3 targeting trispecific protein as described herein is connected to a transmembrane domain via a hinge region, and further a costimulatory domain, a functional signaling domain obtained from OX40, CD27, CD28, CD5, ICAM-1, LFA-1 (CD11a/CD18), ICOS (CD278), or 4-1BB. In some embodiments, the CAR further comprises a sequence encoding an intracellular signaling domain, such as 4-1BB and/or CD3 zeta.

Tumor Growth Reduction Properties

In certain embodiments, the DLL3 targeting trispecific proteins of the disclosure reduce the growth of tumor cells in vivo when administered to a subject who has tumor cells that express DLL3. Measurement of the reduction of the growth of tumor cells can be determined by multiple different methodologies well known in the art. Non-limiting examples include direct measurement of tumor dimension, measurement of excised tumor mass and comparison to control subjects, measurement via imaging techniques (e.g., CT or MRI) that may or may not use isotopes or luminescent molecules (e.g. luciferase) for enhanced analysis, and the like.

In specific embodiments, administration of the trispecific proteins of the disclosure results in a reduction of in vivo growth of tumor cells as compared to a control antigen binding agent by at least about 10%, 20%, 30%, 40%, 50%, 60%, 70%, 80%, 90% or 100%, with an about 100% reduction in tumor growth indicating a complete response and disappearance of the tumor. In further embodiments, administration of the trispecific proteins of the disclosure results in a reduction of in vivo growth of tumor cells as compared to a control antigen binding agent by about 50-100%, about 75-100% or about 90-100%. In further embodiments, administration of the trispecific proteins of the disclosure results in a reduction of in vivo growth of tumor cells as compared to a control antigen binding agent by about 50-60%, about 60-70%, about 70-80%, about 80-90%, or about 90-100%.

DLL3 Targeting Trispecific Protein Modifications

The DLL3 targeting trispecific proteins described herein encompass derivatives or analogs in which (i) an amino acid is substituted with an amino acid residue that is not one encoded by the genetic code, (ii) the mature polypeptide is fused with another compound such as polyethylene glycol, or (iii) additional amino acids are fused to the protein, such as a leader or secretory sequence or a sequence for purification of the protein.

Typical modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphatidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Modifications are made anywhere in DLL3 targeting trispecific proteins described herein, including the peptide backbone, the amino acid side-chains, and the amino or carboxyl termini. Certain common peptide modifications that are useful for modification of DLL3 targeting trispecific proteins include glycosylation, lipid attachment, sulfation, gamma-carboxylation of glutamic acid residues, hydroxylation, blockage of the amino or carboxyl group in a polypeptide, or both, by a covalent modification, and ADP-ribosylation.

In some embodiments, a derivative of the DLL3 targeting trispecific protein as described herein comprises immunoreactive modulator derivatives and antigen binding molecules comprising one or more modifications.

In some embodiments, the trispecific DLL3 binding molecules of the disclosure are monovalent or multivalent, bivalent, trivalent, etc. As used herein, the term "valency" refers to the number of potential target binding sites associated with an antibody. Each target binding site specifically binds one target molecule or specific position or locus on a target molecule. When an antibody is monovalent, each binding site of the molecule will specifically bind to a single antigen position or epitope. When an antibody comprises more than one target binding site (multivalent), each target binding site may specifically bind the same or different molecules (e.g., may bind to different ligands or different antigens, or different epitopes or positions on the same antigen).

In some embodiments, the DLL3 targeting trispecific proteins of this disclosure contain inter alia one or more additional amino acid residue substitutions, mutations and/or modifications which result in a compound with preferred characteristics including, but not limited to: altered pharmacokinetics, increased serum half-life, increase binding affinity, reduced immunogenicity, increased production, altered Fc ligand binding to an Fc receptor (FcR), enhanced or reduced "ADCC" (antibody-dependent cell mediated cytotoxicity) or "CDC" (complement-dependent cytotoxicity) activity, altered glycosylation and/or disulfide bonds and modified binding specificity. In some cases these DLL3 targeting trispecific protein variants are advantageously used to enhance the effective anti-neoplastic properties of the disclosed DLL3 targeting trispecific proteins.

In some embodiments, the DLL3 targeting trispecific proteins of the disclosure have half-lives in a mammals, such as in a human, or in a cynomolgus monkey of less than about 5 days, about 5 days, greater than about 5 days, greater than 10 days, greater than about 15 days, greater than about 20 days, greater than about 25 days, greater than about 30 days, greater than about 35 days, greater than about 40 days, greater than about 45 days, greater than about 2 months, greater than about 3 months, greater than about 4 months, or greater than about 5 months. The increased half-life, in some cases, results in a higher serum titer which thus reduces the frequency of the administration of the DLL3 targeting trispecific proteins, reduces the concentration of the antibodies to be administered, or both.

Still other embodiments comprise one or more engineered glycoforms, i.e., a DLL3 targeting trispecific binding protein comprising an altered glycosylation pattern or altered carbohydrate composition that is covalently attached to the protein. Engineered glycoforms are useful, in some cases, for a variety of purposes, including but not limited to enhancing or reducing effector function, increasing the affinity of the trispecific protein for a target or facilitating production of the trispecific protein. In certain embodiments where reduced effector function is desired, the molecule is engineered to express an aglycosylated form. Substitutions that result in elimination of one or more variable region framework glycosylation sites to thereby eliminate glycosylation at that site, are included in some embodiments. Conversely, enhanced effector functions or improved binding is imparted to the Fc containing trispecific proteins of this disclosure by engineering in one or more additional glycosylation sites, in some cases.

The DLL3 targeting trispecific proteins, in some cases, are differentially modified during or after production, by glycosylation, acetylation, phosphorylation, amidation, derivatization by known protecting/blocking groups, proteolytic cleavage, linkage to an antibody molecule or other cellular ligand, etc. Any of numerous chemical modifications are carried out by techniques, including but not limited to specific chemical cleavage by cyanogen bromide, trypsin, chymotrypsin, papain, V8 protease, NaBH4, acetylation, formylation, oxidation, reduction, metabolic synthesis in the presence of tunicamycin etc.

Various post-translational modifications also encompassed by the disclosure include, for example, N-linked or O-linked carbohydrate chains, processing of N-terminal or C-terminal ends, attachment of chemical moieties to the amino acid backbone, chemical modifications of N-linked or O-linked carbohydrate chains, and addition or deletion of an N-terminal methionine residue as a result of prokaryotic host cell expression. Moreover, the DLL3 targeting trispecific binding proteins are, in some cases, modified with a detectable label, such as an enzymatic, fluorescent, radioisotopic or affinity label to allow for detection and isolation of the modulator.

Polynucleotides Encoding DLL3 Targeting Trispecific Proteins

Also provided, in some embodiments, are polynucleotide molecules encoding an anti-DLL3 trispecific binding protein described herein. In some embodiments, the polynucleotide molecules are provided as a DNA construct. In other embodiments, the polynucleotide molecules are provided as a messenger RNA transcript.

The polynucleotide molecules are constructed by known methods such as by combining the genes encoding the three binding domains either separated by peptide linkers or, in other embodiments, directly linked by a peptide bond, into a single genetic construct operably linked to a suitable promoter, and optionally a suitable transcription terminator, and expressing it in bacteria or other appropriate expression system such as, for example CHO cells. In the embodiments where the DLL3 binding domain is a small molecule, the polynucleotides contain genes encoding the CD3 binding domain and the half-life extension domain. In the embodiments where the half-life extension domain is a small molecule, the polynucleotides contain genes encoding the domains that bind to CD3 and DLL3. Depending on the vector system and host utilized, any number of suitable transcription and translation elements, including constitutive and inducible promoters, may be used. The promoter is selected such that it drives the expression of the polynucleotide in the respective host cell.

In some embodiments, the polynucleotide is inserted into a vector, preferably an expression vector, which represents a further embodiment. This recombinant vector can be constructed according to known methods. Vectors of particular interest include plasmids, phagemids, phage derivatives, virii (e.g., retroviruses, adenoviruses, adeno-associated viruses, herpes viruses, lentiviruses, and the like), and cosmids.

A variety of expression vector/host systems may be utilized to contain and express the polynucleotide encoding the polypeptide of the described trispecific antigen-binding protein. Examples of expression vectors for expression in *E. coli* are pSKK (Le Gall et al., J Immunol Methods. (2004) 285(1):111-27) or pcDNA5 (Invitrogen) for expression in mammalian cells.

Thus, the DLL3 targeting trispecific proteins as described herein, in some embodiments, are produced by introducing a vector encoding the protein as described above into a host cell and culturing said host cell under conditions whereby the protein domains are expressed, may be isolated and, optionally, further purified.

Pharmaceutical Compositions

Also provided, in some embodiments, are pharmaceutical compositions comprising an anti-DLL3 trispecific binding protein described herein, a vector comprising the polynucleotide encoding the polypeptide of the DLL3 targeting trispecific proteins or a host cell transformed by this vector and at least one pharmaceutically acceptable carrier. The term "pharmaceutically acceptable carrier" includes, but is not limited to, any carrier that does not interfere with the effectiveness of the biological activity of the ingredients and that is not toxic to the patient to whom it is administered. Examples of suitable pharmaceutical carriers are well known in the art and include phosphate buffered saline solutions, water, emulsions, such as oil/water emulsions, various types of wetting agents, sterile solutions etc. Such carriers can be formulated by conventional methods and can be administered to the subject at a suitable dose. Preferably, the compositions are sterile. These compositions may also contain adjuvants such as preservative, emulsifying agents and dispersing agents. Prevention of the action of microorganisms may be ensured by the inclusion of various antibacterial and antifungal agents. A further embodiment provides one or more of the above described DLL3 targeting trispecific proteins packaged in lyophilized form, or packaged in an aqueous medium.

In some embodiments of the pharmaceutical compositions, the DLL3 targeting trispecific proteins described herein are encapsulated in nanoparticles. In some embodiments, the nanoparticles are fullerenes, liquid crystals, liposome, quantum dots, superparamagnetic nanoparticles, dendrimers, or nanorods. In other embodiments of the pharmaceutical compositions, the DLL3 targeting trispecific protein is attached to liposomes. In some instances, the DLL3 targeting trispecific proteins are conjugated to the surface of liposomes. In some instances, the DLL3 trispecific antigen-binding protein are encapsulated within the shell of a liposome. In some instances, the liposome is a cationic liposome.

The DLL3 targeting trispecific proteins described herein are contemplated for use as a medicament. Administration is effected by different ways, by intravenous, intraperitoneal, subcutaneous, intramuscular, topical or intradermal administration. In some embodiments, the route of administration depends on the kind of therapy and the kind of compound contained in the pharmaceutical composition. The dosage regimen will be determined by the attending physician and other clinical factors. Dosages for any one patient depends on many factors, including the patient's size, body surface area, age, sex, the particular compound to be administered, time and route of administration, the kind of therapy, general health and other drugs being administered concurrently. An "effective dose" refers to amounts of the active ingredient that are sufficient to affect the course and the severity of the disease, leading to the reduction or remission of such pathology and may be determined using known methods.

In some embodiments, the DLL3 targeting trispecific proteins of this disclosure are administered at a dosage of up to 10 mg/kg at a frequency of once a week. In some cases, the dosage ranges from about 1 ng/kg to about 10 mg/kg. In some embodiments, the dose is from about 1 ng/kg to about 10 ng/kg, about 5 ng/kg to about 15 ng/kg, about 12 ng/kg to about 20 ng/kg, about 18 ng/kg to about 30 ng/kg, about 25 ng/kg to about 50 ng/kg, about 35 ng/kg to about 60 ng/kg, about 45 ng/kg to about 70 ng/kg, about 65 ng/kg to about 85 ng/kg, about 80 ng/kg to about 1 µg/kg, about 0.5 µg/kg to about 5 µg/kg, about 2 µg/kg to about 10 µg/kg, about 7 µg/kg to about 15 µg/kg, about 12 µg/kg to about 25 µg/kg, about 20 µg/kg to about 50 µg/kg, about 35 µg/kg to about 70 µg/kg, about 45 µg/kg to about 80 µg/kg, about 65 µg/kg to about 90 µg/kg, about 85 µg/kg to about 0.1 mg/kg, about 0.095 mg/kg to about 10 mg/kg. In some cases, the dosage is about 0.1 mg/kg to about 0.2 mg/kg; about 0.25 mg/kg to about 0.5 mg/kg, about 0.45 mg/kg to about 1 mg/kg, about 0.75 mg/kg to about 3 mg/kg, about 2.5 mg/kg to about 4 mg/kg, about 3.5 mg/kg to about 5 mg/kg, about 4.5 mg/kg to about 6 mg/kg, about 5.5 mg/kg to about 7 mg/kg, about 6.5 mg/kg to about 8 mg/kg, about 7.5 mg/kg to about 9 mg/kg, or about 8.5 mg/kg to about 10 mg/kg. The frequency of administration, in some embodiments, is about less than daily, every other day, less than once a day, twice a week, weekly, once in 7 days, once in two weeks, once in two weeks, once in three weeks, once in four weeks, or once a month. In some cases, the frequency of administration is weekly. In some cases, the frequency of administration is weekly and the dosage is up to 10 mg/kg. In some cases, duration of administration is from about 1 day to about 4 weeks or longer.

Methods of Treatment

In some embodiments, the DLL3 binding proteins, or DLL3 targeting trispecific proteins of the present disclosure is administered to treat a neoplastic condition. Neoplastic conditions, in some embodiments, are benign or malignant; solid tumors or other blood neoplasia; and, in some embodiments, are selected from the group including, but not limited to: adrenal gland tumors, AIDS-associated cancers, alveolar soft part sarcoma, astrocytic tumors, autonomic ganglia tumors, bladder cancer (squamous cell carcinoma and transitional cell carcinoma), blastocoelic disorders, bone cancer (adamantinoma, aneurismal bone cysts, osteochondroma, osteosarcoma), brain and spinal cord cancers, metastatic brain tumors, breast cancer including triple negative breast cancer, carotid body tumors, cervical cancer, chondrosarcoma, chordoma, chromophobe renal cell carcinoma, clear cell carcinoma, colon cancer, colorectal cancer, cutaneous benign fibrous histiocytomas, desmoplastic small round cell tumors, ependymomas, epithelial disorders, Ewing's tumors, extraskeletal myxoid chondrosarcoma, fibrogenesis imperfecta ossium, fibrous dysplasia of the bone, gallbladder and bile duct cancers, gastric cancer, gastrointestinal, gestational trophoblastic disease, germ cell tumors, glandular disorders, head and neck cancers, hypothalamic, intestinal cancer, islet cell tumors, Kaposi's Sarcoma, kidney cancer (nephroblastoma, papillary renal cell carcinoma), leukemias, lipoma/benign lipomatous tumors, liposarcoma/malignant lipomatous tumors, liver cancer (hepatoblastoma, hepatocellular carcinoma), lymphomas, lung cancers (small cell carcinoma, adenocarcinoma, squamous cell carcinoma, large cell carcinoma etc.), macrophagal disorders, medulloblastoma, melanoma, meningiomas, multiple endocrine neoplasia, multiple myeloma, myelodysplastic syndrome, neuroblastoma, neuroendocrine tumors, ovarian cancer, pancreatic cancers, papillary thyroid carcinomas, parathyroid tumors, pediatric cancers, peripheral nerve sheath tumors, phaeochromocytoma, pituitary tumors, prostate cancer, posterior unveal melanoma, rare hematologic disorders, renal metastatic cancer, rhabdoid tumor, rhabdomysarcoma, sarcomas, skin cancer, soft-tissue sarcomas, squamous cell cancer, stomach cancer, stromal disorders, synovial sarcoma, testicular cancer, thymic carcinoma, thymoma, thyroid metastatic cancer, and uterine cancers (carcinoma of the cervix, endometrial carcinoma, and leiomyoma).

In certain embodiments the DLL3 binding proteins, or the DLL3 targeting trispecific proteins of the present disclosure is used as a front line therapy and administered to subjects who have not previously been treated for the cancerous condition. In other embodiments the DLL3 targeting trispecific proteins of the present disclosure are used to treat subjects that have previously been treated (with a DLL3 targeting trispecific protein of this disclosure or with other anti-cancer agent) and have relapsed or determined to be refractory to the previous treatment. In some embodiments the DLL3 targeting trispecific proteins of the present disclosure are used to treat subjects that have recurrent tumors.

In some aspects, the DLL3 binding proteins, or the DLL3 targeting trispecific proteins of the present disclosure are administered to treat a proliferative disorder comprising a solid tumor including, but not limited to, adrenal, liver, kidney, bladder, breast, gastric, ovarian, cervical, uterine, esophageal, colorectal, prostate, pancreatic, lung (both small cell and non-small cell), thyroid, carcinomas, sarcomas, glioblastomas and various head and neck tumors.

In some embodiments, the DLL3 binding proteins, or the DLL3 targeting trispecific proteins of the present disclosure are administered to a subject suffering from melanoma. In some embodiments, the DLL3 targeting trispecific proteins of the present disclosure are used to diagnose, monitor, treat or prevent melanoma. The term "melanoma," as used herein, includes all types of melanoma including, but not limited to, primary melanoma, malignant melanoma, cutaneous melanoma, extracutaneous melanoma, superficial spreading melanoma, polypoid melanoma, melanocarcinomas, melanoepitheliomas, melanosarcomas, melanoma in situ, nodular malignant melanoma, lentigo maligna melanoma, lentiginous melanoma, lentiginous malignant melanoma, mucosal lentiginous melanoma, mucosal melanoma, acral lentiginous melanoma, soft tissue melanoma, ocular melanoma, invasive melanoma, familial atypical mole and melanoma (FAM-M) syndrome, desmoplastic malignant melanoma or uveal melanoma.

DLL3 is an effective tumor marker that is expressed on a number of different cancers and has been found to be associated with cancer stem cells. Thus, in some embodiments where the DLL3 binding proteins, or the DLL3 targeting trispecific proteins of the disclosure are incorporated in a chimeric antigen receptor expressed on lymphocytes, the resulting "DLL3 sensitized lymphocytes" (e.g., natural killer cells or T cells that immunospecifically recognize a DLL3 determinant) are able to effectively mount an immune response directed to aberrant DLL3 positive cells including cancer stem cells. This ability to effectively eliminate tumorigenic "seed" cells is often critical in reducing the possibility of tumor recurrence or metastasis. In some embodiments, such DLL3 sensitized lymphocytes are used in combination with other therapeutic agents or as part of a maintenance regimen following standard of care treatments.

More generally a chimeric antigen receptor is an artificially constructed hybrid protein or polypeptide containing or comprising an antigen binding domain of an antibody linked to a signaling domain (e.g., T-cell signaling or T-cell activation domains). In some embodiments, CARs comprising the DLL3 targeting trispecific binding protein of the present disclosure have the ability to redirect the specificity and reactivity of sensitized lymphocytes (e.g., T-cells) toward DLL3 positive target cells in a non-WIC-restricted manner by exploiting the antigen-binding properties of antibodies or antigen binding fragments thereof. The non-MHC-restricted antigen recognition gives T-cells expressing DLL3 CARs the ability to recognize tumorigenic DLL3 independent of antigen processing, thus bypassing a major mechanism of tumor escape. Moreover, when expressed in T-cells, CARs advantageously do not dimerize with endogenous T cell receptor (TCR) alpha and beta chains.

In selected aspects the DLL3 binding proteins, or the DLL3 targeting trispecific proteins of the disclosure is incorporated into a chimeric antigen receptor (CAR) and the DLL3 CAR is administered in a CAR based therapy effective at treating lung cancer, including the following subtypes: small cell lung cancer, non-small cell lung cancer (e.g., squamous cell non-small cell lung cancer or squamous cell small cell lung cancer) and large cell neuroendocrine carcinoma (LCNEC).

In some embodiments, the DLL3 binding proteins, or the DLL3 sensitive lymphocytes are administered to patients exhibiting limited stage disease or extensive stage disease. In other embodiments the disclosed DLL3 targeting trispecific antibodies are administered to refractory patients (i.e., those whose disease recurs during or shortly after completing a course of initial therapy); sensitive patients (i.e., those whose relapse is longer than 2-3 months after primary therapy); or patients exhibiting resistance to a platinum based agent (e.g., carboplatin, cisplatin, oxaliplatin) and/or a taxane (e.g., docetaxel, paclitaxel, larotaxel or cabazitaxel). In another embodiment the disclosed DLL3 CAR treatments are effective at treating ovarian cancer, including ovarian-serous carcinoma and ovarian-papillary serous carcinoma.

The disclosed DLL3 binding proteins, or the DLL3 targeting trispecific binding proteins, in some embodiments, are used to prevent, treat or diagnose tumors with neuroendocrine features or phenotypes including neuroendocrine tumors. True or canonical neuroendocrine tumors (NETs) arising from the dispersed endocrine system are relatively rare, with an incidence of 2-5 per 100,000 people, but highly aggressive. Neuroendocrine tumors occur in the kidney, genitourinary tract (bladder, prostate, ovary, cervix, and endometrium), gastrointestinal tract (colon, stomach), thyroid (medullary thyroid cancer), and lung (small cell lung carcinoma and large cell neuroendocrine carcinoma). These tumors may secrete several hormones including serotonin and/or chromogranin A that can cause debilitating symptoms known as carcinoid syndrome. Such tumors can be denoted by positive immunohistochemical markers such as neuron-specific enolase (NSE, also known as gamma enolase, gene symbol=ENO2), CD56 (or NCAM1), chromogranin A (CHGA), and synaptophysin (SYP) or by genes known to exhibit elevated expression such as ASCL1. Traditional chemotherapies have not been particularly effective in treating neuroendocrine tumors and liver metastasis is a common outcome. In some embodiments the disclosed DLL3 targeting trispecific antibodies are advantageously used to treat neuroendocrine tumors, and in some embodiments they are used to treat, prevent or diagnose pseudo neuroendocrine tumors (pNETs) that genotypically or phenotypically mimic, resemble or exhibit common traits with canonical neuroendocrine tumors. Pseudo neuroendocrine tumors or tumors with neuroendocrine features are tumors that arise from cells of the diffuse neuroendocrine system or from cells in which a neuroendocrine differentiation cascade has been aberrantly reactivated during the oncogenic process. Such pNETs commonly share certain phenotypic or biochemical characteristics with traditionally defined neuroendocrine tumors, including the ability to produce subsets of biologically active amines, neurotransmitters, and peptide hormones. Histologically, such tumors (NETs and pNETs) share a common appearance often showing densely connected small cells with minimal cytoplasm of bland cytopathology and round to oval stippled nuclei. In some embodiments of the present disclosure commonly expressed histological markers or genetic markers that are used to define neuroendocrine and pseudo neuroendocrine tumors include, but are not limited to, chromogranin A, CD56, synaptophysin, PGP9.5, ASCL1 and neuron-specific enolase (NSE). Accordingly, in some embodiments, the DLL3 targeting trispecific protein of the disclosure, the DLL3 CAR, or the DLL3 sensitized lymphocytes, or any combination thereof, of the present disclosure, are beneficially used to treat both pseudo neuroendocrine tumors and canonical neuroendocrine tumors, such as to treat neuroendocrine tumors (both NET and pNET) arising in the kidney, genitourinary tract (bladder, prostate, ovary, cervix, and endometrium), gastrointestinal tract (colon, stomach), thyroid (medullary thyroid cancer), and lung (small cell lung carcinoma and large cell neuroendocrine carcinoma). Moreover, in some embodiments, the DLL3 targeting trispecific protein of the disclosure, the DLL3 CAR, or the DLL3 sensitized lymphocytes, or any combination thereof are used to treat tumors expressing one or more markers such as NSE, CD56, synaptophysin, chromogranin A, ASCL1, or PGP9.5 (UCHL1). In some embodiments, the DLL3 targeting trispecific protein of the disclosure, the DLL3 CAR, or the DLL3 sensitized lymphocytes, or any combination thereof are used to treat a subject suffering from a tumor that is NSE+ or CD56+ or PGP9.5+ or ASCL1+ or SYP+ or CHGA+ or any combination thereof.

In another embodiment the DLL3 targeting trispecific protein of the disclosure, the DLL3 CAR, or the DLL3 sensitized lymphocytes, or any combination thereof are used in maintenance therapy to reduce or eliminate the chance of tumor recurrence following the initial presentation of the disease. In some cases, the disorder has been treated and the initial tumor mass eliminated, reduced or otherwise ameliorated so the patient is asymptomatic or in remission. At such time the subject is administered pharmaceutically effective amounts of the disclosed the DLL3 binding proteins, the DLL3 targeting trispecific protein of the disclosure, the DLL3 CAR, or the DLL3 sensitized lymphocytes, or any combination thereof one or more times regardless of if there is little or no indication of disease using standard diagnostic procedures. In some embodiments, the DLL3 targeting trispecific protein of the disclosure, the DLL3 CAR, or the DLL3 sensitized lymphocytes, or any combination thereof is administered on a regular schedule over a period of time, such as weekly, every two weeks, monthly, every six weeks, every two months, every three months every six months or annually, for example, to reduce the potential of disease recurrence. Moreover such treatments are in some embodiments continued for a period of weeks, months, years or even indefinitely depending on the patient response and clinical and diagnostic parameters.

In yet another embodiment the DLL3 binding proteins, the DLL3 targeting trispecific protein of the disclosure, the DLL3 CAR, or the DLL3 sensitized lymphocytes, or any combination thereof are used to prophylactically or as an adjuvant therapy to prevent or reduce the possibility of tumor metastasis following a debulking procedure. As used in the present disclosure a "debulking procedure" is defined broadly and means any procedure, technique or method that eliminates, reduces, treats or ameliorates a tumor or tumor proliferation. Exemplary debulking procedures include, but are not limited to, surgery, radiation treatments (i.e., beam radiation), chemotherapy, immunotherapy or ablation. In some embodiments, at appropriate times, the DLL3 binding proteins, the DLL3 targeting trispecific protein of the disclosure, the DLL3 CAR, or the DLL3 sensitized lymphocytes, or any combination thereof are administered as suggested by clinical, diagnostic or theranostic procedures to reduce tumor metastasis. In some embodiments, the dosing regimen is accompanied by appropriate diagnostic or monitoring techniques that allow it to be modified.

Yet other embodiments of the disclosure comprise administering the DLL3 binding proteins, the DLL3 targeting trispecific protein of the disclosure, the DLL3 CAR, or the DLL3 sensitized lymphocytes, or any combination thereof to subjects that are asymptomatic but at risk of developing a proliferative disorder. That is, in some embodiments, the DLL3 binding proteins, the DLL3 targeting trispecific protein of the disclosure, the DLL3 CAR, or the DLL3 sensitized lymphocytes, or any combination thereof are used in preventative sense and given to patients that have been examined or tested and have one or more noted risk factors (e.g., genomic indications, family history, in vivo or in vitro test results, etc.) but have not developed neoplasia. In such cases those skilled in the art would be able to determine an effective dosing regimen through empirical observation or through accepted clinical practices.

As used herein, in some embodiments, "treatment" or "treating" or "treated" refers to therapeutic treatment wherein the object is to slow (lessen) an undesired physiological condition, disorder or disease, or to obtain beneficial or desired clinical results. For the purposes described herein, beneficial or desired clinical results include, but are not limited to, alleviation of symptoms; diminishment of the extent of the condition, disorder or disease; stabilization (i.e., not worsening) of the state of the condition, disorder or disease; delay in onset or slowing of the progression of the condition, disorder or disease; amelioration of the condition, disorder or disease state; and remission (whether partial or total), whether detectable or undetectable, or enhancement or improvement of the condition, disorder or disease. Treatment includes eliciting a clinically significant response without excessive levels of side effects. Treatment also includes prolonging survival as compared to expected survival if not receiving treatment. In other embodiments, "treatment" or "treating" or "treated" refers to prophylactic measures, wherein the object is to delay onset of or reduce severity of an undesired physiological condition, disorder or disease, such as, for example is a person who is predisposed to a disease (e.g., an individual who carries a genetic marker for a disease such as breast cancer).

In some embodiments of the methods described herein, the DLL3 binding proteins, the DLL3 targeting trispecific proteins, or compositions as described herein are administered in combination with an agent for treatment of the particular disease, disorder or condition. Agents include but are not limited to, therapies involving antibodies, small molecules (e.g., chemotherapeutics), hormones (steroidal, peptide, and the like), radiotherapies (γ-rays, X-rays, and/or the directed delivery of radioisotopes, microwaves, UV radiation and the like), gene therapies (e.g., antisense, retroviral therapy and the like) and other immunotherapies. In some embodiments, an anti-DLL3 binding protein, or an anti-DLL3 targeting trispecific protein as described herein is administered in combination with anti-diarrheal agents, anti-emetic agents, analgesics, opioids and/or non-steroidal anti-inflammatory agents. In some embodiments, an anti-DLL3 binding protein, or an anti-DLL3 targeting trispecific protein as described herein is administered in combination with anti-cancer agents. Non-limiting examples of anti-cancer agents that can be used in the various embodiments of the disclosure, including pharmaceutical compositions and dosage forms and kits of the disclosure, include: acivicin; aclarubicin; acodazole hydrochloride; acronine; adozelesin; aldesleukin; altretamine; ambomycin; ametantrone acetate; aminoglutethimide; amsacrine; anastrozole; anthramycin; asparaginase; asperlin; azacitidine; azetepa; azotomycin; batimastat; benzodepa; bicalutamide; bisantrene hydrochloride; bisnafide dimesylate; bizelesin; bleomycin sulfate; brequinar sodium; bropirimine; busulfan; cactinomycin; calusterone; caracemide; carbetimer; carboplatin; carmustine; carubicin hydrochloride; carzelesin; cedefingol; chlorambucil; cirolemycin; cisplatin; cladribine; crisnatol mesylate; cyclophosphamide; cytarabine; dacarbazine; dactinomycin; daunorubicin hydrochloride; decitabine; dexormaplatin; dezaguanine; dezaguanine mesylate; diaziquone; docetaxel; doxorubicin; doxorubicin hydrochloride; droloxifene; droloxifene citrate; dromostanolone propionate; duazomycin; edatrexate; eflornithine hydrochloride; elsamitrucin; enloplatin; enpromate; epipropidine; epirubicin hydrochloride; erbulozole; esorubicin hydrochloride; estramustine; estramustine phosphate sodium; etanidazole; etoposide; etoposide phosphate; etoprine; fadrozole hydrochloride; fazarabine; fenretinide; floxuridine; fludarabine phosphate; fluorouracil; flurocitabine; fosquidone; fostriecin sodium; gemcitabine; gemcitabine hydrochloride; hydroxyurea; idarubicin hydrochloride; ifosfamide; ilmofosine; interleukin II (including recombinant interleukin II, or rIL2), interferon alpha-2a; interferon alpha-2b; interferon alpha-n1 interferon alpha-n3; interferon beta-I a; interferon gamma-I b; iproplatin; irinotecan hydrochloride; lanreotide acetate; letrozole; leuprolide acetate; liarozole hydrochloride; lometrexol sodium; lomustine; losoxantrone hydrochloride; masoprocol; maytansine; mechlorethamine hydrochloride; megestrol acetate; melengestrol acetate; melphalan; menogaril; mercaptopurine; methotrexate; methotrexate sodium; metoprine; meturedepa; mitindomide; mitocarcin; mitocromin; mitogillin; mitomalcin; mitomycin; mitosper; mitotane; mitoxantrone hydrochloride; mycophenolic acid; nocodazole; nogalamycin; ormaplatin; oxisuran; paclitaxel; pegaspargase; peliomycin; pentamustine; peplomycin sulfate; perfosfamide; pipobroman; piposulfan; piroxantrone hydrochloride; plicamycin; plomestane; porfimer sodium; porfiromycin; prednimustine; procarbazine hydrochloride; puromycin; puromycin hydrochloride; pyrazofurin; riboprine; rogletimide; safingol; safingol hydrochloride; semustine; simtrazene; sparfosate sodium; sparsomycin; spirogermanium hydrochloride; spiromustine; spiroplatin; streptonigrin; streptozocin; sulofenur; talisomycin; tecogalan sodium; tegafur; teloxantrone hydrochloride; temoporfin; teniposide; teroxirone; testolactone; thiamiprine; thioguanine; thiotepa; tiazofurin; tirapazamine; toremifene citrate; trestolone acetate; triciribine phosphate; trimetrexate; trimetrexate glucuronate; triptorelin; tubulozole hydrochloride; uracil mustard; uredepa; vapreotide; verteporfin; vinblastine sulfate; vincristine sulfate; vindesine; vindesine sulfate; vinepidine sulfate; vinglycinate sulfate; vinleurosine sulfate; vinorelbine tartrate; vinzolidine sulfate; vinzolidine sulfate; vorozole; zeniplatin; zinostatin; zorubicin hydrochloride. Other examples of anti-cancer drugs include, but are not limited to: 20-epi-1,25 dihydroxyvitamin D3; 5-ethynyluracil; abiraterone; aclarubicin; acylfulvene; adecypenol; adozelesin; aldesleukin; ALL-TK antagonists; altretamine; ambamustine; amidox; amifostine; aminolevulinic acid; amrubicin; amsacrine; anagrelide; anastrozole; andrographolide; angiogenesis inhibitors; antagonist D; antagonist G; antarelix; anti-dorsalizing morphogenetic protein-1; antiandrogen, prostatic carcinoma; antiestrogen; antineoplaston; antisense oligonucleotides; aphidicolin glycinate; apoptosis gene modulators; apoptosis regulators; apurinic acid; ara-CDP-DL-PTBA; arginine deaminase; asulacrine; atamestane; atrimustine; axinastatin 1; axinastatin 2; axinastatin 3; azasetron; azatoxin; azatyrosine; baccatin III derivatives; balanol; batimastat; BCR/ABL antagonists; benzochlorins; benzoylstaurosporine; beta lactam derivatives; beta-alethine; betaclamycin B; betulinic acid; bFGF inhibitor; bicalutamide; bisantrene; bisaziridinylspermine; bisnafide; bistratene A; bizelesin; breflate; bropirimine; budotitane; buthionine sulfoximine; calcipotriol; calphostin C; camptothecin derivatives; canarypox IL-2; capecitabine; carboxamide-amino-triazole; carboxyamidotriazole; CaRest M3; CARN 700; cartilage derived inhibitor; carzelesin; casein kinase inhibitors (ICOS); castanospermine; cecropin B; cetrorelix; chlorins; chloroquinoxaline sulfonamide; cicaprost; cis-porphyrin; cladribine; clomifene analogues; clotrimazole; collismycin A; collismycin B; combretastatin A4; combretastatin analogue; conagenin; crambescidin 816; crisnatol; cryptophycin 8; cryptophycin A derivatives; curacin A; cyclopentanthraquinones; cycloplatam; cypemycin; cytarabine ocfosfate; cytolytic factor; cytostatin; dacliximab; decitabine; dehydrodidemnin B; deslorelin; dexamethasone; dexifosfamide; dexrazoxane; dexverapamil; diaziquone; didemnin B; didox; diethylnorspermine; dihydro-5-azacytidine; dihydrotaxol, 9-; dioxamycin; diphenyl spiromustine; docetaxel; docosanol; dolasetron; doxifluridine; droloxifene; dronabinol; duocarmycin SA; ebselen; ecomustine; edelfosine; edrecolomab; eflornithine; elemene; emitefur; epirubicin; epristeride; estramustine analogue; estrogen agonists; estrogen antagonists; etanidazole; etoposide phosphate; exemestane; fadrozole; fazarabine; fenretinide; filgrastim; finasteride; flavopiridol; flezelastine; fluasterone; fludarabine; fluorodaunorunicin hydrochloride; forfenimex; formestane; fostriecin; fotemustine; gadolinium texaphyrin; gallium nitrate; galocitabine; ganirelix; gelatinase inhibitors; gemcitabine; glutathione inhibitors; hepsulfam; heregulin; hexamethylene bisacetamide; hypericin; ibandronic acid; idarubicin; idoxifene; idramantone; ilmofosine; ilomastat; imidazoacridones; imiquimod; immunostimulant peptides; insulin-like growth factor-I receptor inhibitor; interferon agonists; interferons; interleukins; iobenguane; iododoxorubicin; ipomeanol, 4-; iroplact; irsogladine; isobengazole; isohomohalicondrin B; itasetron; jasplakinolide; kahalalide F; lamellarin-N triacetate; lanreotide; leinamycin; lenograstim; lentinan sulfate; leptolstatin; letrozole; leukemia inhibiting factor; leukocyte alpha interferon; leuprolide+estrogen+progesterone; leuprorelin; levamisole; liarozole; linear polyamine analogue; lipophilic disaccharide peptide; lipophilic platinum compounds; lissoclinamide 7; lobaplatin; lombricine; lometrexol; lonidamine; losoxantrone; HMG-CoA reductase inhibitor (such as but not limited to, Lovastatin, Pravastatin, Fluvastatin, Statin, Simvastatin, and Atorvastatin); loxoribine; lurtotecan; lutetium texaphyrin; lysofylline; lytic peptides; maitansine; mannostatin A; marimastat; masoprocol; maspin; matrilysin inhibitors; matrix metalloproteinase inhibitors; menogaril; merbarone; meterelin; methioninase; metoclopramide; MIF inhibitor; mifepristone; miltefosine; mirimostim; mismatched double stranded RNA; mitoguazone; mitolactol; mitomycin analogues; mitonafide; mitotoxin fibroblast growth factor-saporin; mitoxantrone; mofarotene; molgramostim; monoclonal antibody, human chorionic gonadotrophin; monophosphoryl lipid A+myobacterium cell wall sk; mopidamol; multiple drug resistance gene inhibitor; multiple tumor suppressor 1-based therapy; mustard anticancer agent; mycaperoxide B; mycobacterial cell wall extract; myriaporone; N-acetyldinaline; N-substituted benzamides; nafarelin; nagrestip; naloxone+pentazocine; napavin; naphterpin; nartograstim; nedaplatin; nemorubicin; neridronic acid; neutral endopeptidase; nilutamide; nisamycin; nitric oxide modulators; nitroxide antioxidant; nitrullyn; O6-benzylguanine; octreotide; okicenone; oligonucleotides; onapristone; ondansetron; ondansetron; oracin; oral cytokine inducer; ormaplatin; osaterone; oxaliplatin; oxaunomycin; paclitaxel; paclitaxel analogues; paclitaxel derivatives; palauamine; palmitoylrhizoxin; pamidronic acid; panaxytriol; panomifene; parabactin; pazelliptine; pegaspargase; peldesine; pentosan polysulfate sodium; pentostatin; pentrozole; perflubron; perfosfamide; perillyl alcohol; phenazinomycin; phenylacetate; phosphatase inhibitors; picibanil; pilocarpine hydrochloride; pirarubicin; piritrexim; placetin A; placetin B; plasminogen activator inhibitor; platinum complex; platinum compounds; platinum-triamine complex; porfimer sodium; porfiromycin; prednisone; propyl bis-acridone; prostaglandin J2; proteasome inhibitors; protein A-based immune modulator; protein kinase C inhibitor; protein kinase C inhibitors, microalgal; protein tyrosine phosphatase inhibitors; purine nucleoside phosphorylase inhibitors; purpurins; pyrazoloacridine; pyridoxylated hemoglobin polyoxyethylene conjugate; raf antagonists; raltitrexed; ramosetron; ras farnesyl protein transferase inhibitors; ras inhibitors; ras-GAP inhibitor; retelliptine demethylated; rhenium Re 186 etidronate; rhizoxin; ribozymes; RII retinamide; rogletimide; rohitukine; romurtide; roquinimex; rubiginone B1; ruboxyl; safingol; saintopin; SarCNU; sarcophytol A; sargramostim; Sdi 1 mimetics; semustine; senescence derived inhibitor 1; sense oligonucleotides; signal transduction inhibitors; signal transduction modulators; single chain antigen binding protein; sizofiran; sobuzoxane; sodium borocaptate; sodium phenylacetate; solverol; somatomedin binding protein; sonermin; sparfosic acid; spicamycin D; spiromustine; splenopentin; spongistatin 1; squalamine; stem cell inhibitor; stem-cell division inhibitors; stipiamide; stromelysin inhibitors; sulfinosine; superactive vasoactive intestinal peptide antagonist; suradista; suramin; swainsonine; synthetic glycosaminoglycans; tallimustine; tamoxifen methiodide; tauromustine; tazarotene; tecogalan sodium; tegafur; tellurapyrylium; telomerase inhibitors; temoporfin; temozolomide; teniposide; tetrachlorodecaoxide; tetrazomine; thaliblastine; thiocoraline; thrombopoietin; thrombopoietin mimetic; thymalfasin; thymopoietin receptor agonist; thymotrinan; thyroid stimulating hormone; tin ethyl etiopurpurin; tirapazamine; titanocene bichloride; topsentin; toremifene; totipotent stem cell factor; translation inhibitors; tretinoin; triacetyluridine; triciribine; trimetrexate; triptorelin; tropisetron; turosteride; tyrosine kinase inhibitors; tyrphostins; UBC inhibitors; ubenimex; urogenital sinus-derived growth inhibitory factor; urokinase receptor antagonists; vapreotide; variolin B; vector system, erythrocyte gene therapy; velaresol; veramine; verdins; verteporfin; vinorelbine; vinxaltine; Vitaxin®; vorozole; zanoterone; zeniplatin; zilascorb; and zinostatin stimalamer. Additional anti-cancer drugs are 5-fluorouracil and leucovorin. These two agents are particularly useful when used in methods employing thalidomide and a topoisomerase inhibitor. In some embodiments, the DLL3 targeting trispecific protein of the present disclosure is used in combination with gemcitabine. In some embodiments, the DLL3 targeting trispecific protein as described herein is administered before, during, or after surgery.

Methods of Detection of DLL3 Expression and Diagnosis of DLL3 Associated Cancer

According to another embodiment of the disclosure, kits for detecting expression of DLL3 in vitro or in vivo are provided. The kits include the foregoing DLL3 binding proteins, DLL3 targeting trispecific proteins (e.g., a trispecific protein containing a labeled anti-DLL3 single domain antibody or antigen binding fragments thereof), and one or more compounds for detecting the label. In some embodiments, the label is selected from the group consisting of a fluorescent label, an enzyme label, a radioactive label, a nuclear magnetic resonance active label, a luminescent label, and a chromophore label.

In some cases, DLL3 expression is detected in a biological sample. The sample can be any sample, including, but not limited to, tissue from biopsies, autopsies and pathology specimens. Biological samples also include sections of tissues, for example, frozen sections taken for histological purposes. Biological samples further include body fluids, such as blood, serum, plasma, sputum, spinal fluid or urine. A biological sample is typically obtained from a mammal, such as a human or non-human primate.

In one embodiment, provided is a method of determining if a subject has cancer by contacting a sample from the subject with an anti-DLL3 single domain antibody or an anti-DLL3 trispecific protein as disclosed herein; and detecting binding of the single domain antibody to the sample. An increase in binding of the antibody to the sample as compared to binding of the antibody to a control sample identifies the subject as having cancer.

In another embodiment, provided is a method of confirming a diagnosis of cancer in a subject by contacting a sample from a subject diagnosed with cancer with an anti-DLL3 single domain antibody or an anti-DLL3 trispecific protein as disclosed herein; and detecting binding of the antibody to the sample. An increase in binding of the antibody to the sample as compared to binding of the antibody to a control sample confirms the diagnosis of cancer in the subject.

In some examples of the disclosed methods, the DLL3 binding protein, or the DLL3 binding single domain antibody of the trispecific protein is directly labeled. In some examples, the methods further include contacting a second antibody that specifically binds an anti-DLL3 single domain antibody or an anti-DLL3 trispecific protein with the sample; and detecting the binding of the second antibody. An increase in binding of the second antibody to the sample as compared to binding of the second antibody to a control sample detects cancer in the subject or confirms the diagnosis of cancer in the subject. In some cases, the cancer is a neuroendocrine cancer, prostate cancer, lung cancer, stomach cancer, squamous cell carcinoma, pancreatic cancer, cholangiocarcinoma, triple negative breast cancer or ovarian cancer, or any other type of cancer that expresses DLL3. In some examples, the control sample is a sample from a subject without cancer. In particular examples, the sample is a blood or tissue sample.

In some cases, the antibody that binds (for example specifically binds) DLL3 is directly labeled with a detectable label. In another embodiment, the antibody that binds (for example, specifically binds) DLL3 (the first antibody) is unlabeled and a second antibody or other molecule that can bind the antibody that specifically binds DLL3 is labeled. A second antibody is chosen such that it is able to specifically bind the specific species and class of the first antibody. For example, if the first antibody is a llama IgG, then the secondary antibody may be an anti-llama-IgG. Other molecules that can bind to antibodies include, without limitation, Protein A and Protein G, both of which are available commercially. Suitable labels for the antibody or secondary antibody are described above, and include various enzymes, prosthetic groups, fluorescent materials, luminescent materials, magnetic agents and radioactive materials. Non-limiting examples of suitable enzymes include horseradish peroxidase, alkaline phosphatase, beta-galactosidase, or acetylcholinesterase. Non-limiting examples of suitable prosthetic group complexes include streptavidin/biotin and avidin/biotin. Non-limiting examples of suitable fluorescent materials include umbelliferone, fluorescein, fluorescein isothiocyanate, rhodamine, dichlorotriazinylamine fluorescein, dansyl chloride or phycoerythrin. A non-limiting exemplary luminescent material is luminol; a non-limiting exemplary a magnetic agent is gadolinium, and non-limiting exemplary radioactive labels include 125I, 131I, 35S or 3H.

In an alternative embodiment, DLL3 can be assayed in a biological sample by a competition immunoassay utilizing DLL3 standards labeled with a detectable substance and an unlabeled antibody that specifically binds DLL3. In this assay, the biological sample, the labeled DLL3 standards and the antibody that specifically bind DLL3 are combined and the amount of labeled DLL3 standard bound to the unlabeled antibody is determined. The amount of DLL3 in the biological sample is inversely proportional to the amount of labeled DLL3 standard bound to the antibody that specifically binds DLL3.

The immunoassays and method disclosed herein can be used for a number of purposes. In one embodiment, the antibody that specifically binds DLL3 may be used to detect the production of DLL3 in cells in cell culture. In another embodiment, the antibody can be used to detect the amount of DLL3 in a biological sample, such as a tissue sample, or a blood or serum sample. In some examples, the DLL3 is cell-surface DLL3. In other examples, the DLL3 is soluble DLL3 (e.g., DLL3 in a cell culture supernatant or soluble DLL3 in a body fluid sample, such as a blood or serum sample).

In one embodiment, a kit is provided for detecting DLL3 in a biological sample, such as a blood sample or tissue sample. For example, to confirm a cancer diagnosis in a subject, a biopsy can be performed to obtain a tissue sample for histological examination. Alternatively, a blood sample can be obtained to detect the presence of soluble DLL3 protein or fragment. Kits for detecting a polypeptide will typically comprise a single domain antibody, according to the present disclosure, that specifically binds DLL3. In some embodiments, an antibody fragment, such as an scFv fragment, a VH domain, or a Fab is included in the kit. In a further embodiment, the antibody is labeled (for example, with a fluorescent, radioactive, or an enzymatic label).

In one embodiment, a kit includes instructional materials disclosing means of use of an antibody that binds DLL3. The instructional materials may be written, in an electronic form (such as a computer diskette or compact disk) or may be visual (such as video files), or provided through an electronic network, for example, over the internet, World Wide Web, an intranet, or other network. The kits may also include additional components to facilitate the particular application for which the kit is designed. Thus, for example, the kit may additionally contain means of detecting a label (such as enzyme substrates for enzymatic labels, filter sets to detect fluorescent labels, appropriate secondary labels such as a secondary antibody, or the like). The kits may additionally include buffers and other reagents routinely used for the practice of a particular method. Such kits and appropriate contents are well known to those of skill in the art.

In one embodiment, the diagnostic kit comprises an immunoassay. Although the details of the immunoassays may vary with the particular format employed, the method of detecting DLL3 in a biological sample generally includes the steps of contacting the biological sample with an antibody which specifically reacts, under immunologically reactive conditions, to a DLL3 polypeptide. The antibody is allowed to specifically bind under immunologically reactive conditions to form an immune complex, and the presence of the immune complex (bound antibody) is detected directly or indirectly.

Methods of determining the presence or absence of a cell surface marker are well known in the art. For example, the antibodies can be conjugated to other compounds including, but not limited to, enzymes, magnetic beads, colloidal magnetic beads, haptens, fluorochromes, metal compounds, radioactive compounds or drugs. The antibodies can also be utilized in immunoassays such as but not limited to radioimmunoassays (RIAs), ELISA, or immunohistochemical assays. The antibodies can also be used for fluorescence activated cell sorting (FACS). FACS employs a plurality of color channels, low angle and obtuse light-scattering detection channels, and impedance channels, among other more sophisticated levels of detection, to separate or sort cells (see U.S. Pat. No. 5,061,620). Any of the single domain antibodies that bind DLL3, as disclosed herein, can be used in these assays. Thus, the antibodies can be used in a conventional immunoassay, including, without limitation, an ELISA, an RIA, FACS, tissue immunohistochemistry, Western blot or immunoprecipitation.

EXAMPLES

Example 1: Screening of Phage Display Library for Identification of DLL3 Binding Domains Llamas were immunized with purified DLL3 protein expressed in EXPI293™ cells. A phage display library for expression of heavy chain variable antibody domains was constructed from circulating B cells (see van der Linden, de Geus, Stok, Bos, van Wassenaar, Verrips, and Frenken. 2000. J Immunol Methods 240:185-195). Phage clones were screening for binding to DLL3 by expressing the clones in *E. coli*, preparing periplasmic extracts, and screening the clones for DLL3 binding activity by ELISA. Fifty-two unique heavy chain only single domain antibodies were identified that produced a signal in the ELISA screening (SEQ ID Nos. 1 to 52). The CDR1, CDR2, and CDR3 sequences for these heavy variable domains were, respectively, SEQ ID Nos. 443 to 494, SEQ ID Nos. 885 to 936, and SEQ ID Nos. 1327 to 1378.

Example 2: Humanization of DLL3 Binding Single Domain Antibodies and T Cell Dependent Cellular Cytotoxicity Assay Thirty-four (SEQ ID Nos. 53 to 86) exemplary llama anti-DLL3 heavy chain only single domain antibodies from Example 1 were humanized. The CDR1, CDR2, and CDR3 sequences for the 34 heavy chain only single domain antibodies were, respectively, SEQ ID Nos. 495 to 528, SEQ ID Nos. 937 to 970, and SEQ ID Nos. 1379 to 1412.

The humanized anti-DLL3 sequences were cloned into an expression vector, in an expression construct comprising a signal domain followed by an anti-DLL3 heavy chain only variable domain followed by a GGGGSGGGS linker (SEQ ID No. 1808) followed by anti-human albumin single domain antibody 10G (SEQ ID No. 1774) followed by a GGGGSGGGS linker (SEQ ID No. 1808) followed by anti-human CD3 antibody 2B2 (SEQ ID No. 1793) followed by a HHHHHH tag (SEQ ID No. 1819), to generate anti-DLL3 trispecific constructs.

The anti-DLL3 trispecific constructs containing the humanized anti-DLL3 binding sequences were then transfected into EXPI293™ cells. These anti-DLL3 trispecific constructs have an engineered with a protein A binding site, and the amount of anti-DLL3 trispecific construct in the conditioned media from the transfected EXPI293™ cells was quantitated using an Octet instrument with protein A tips. A trispecific protein of similar molecular weight as the anti-DLL3 trispecific proteins was used as a standard.

Using conditioned media containing known concentrations of anti-DLL3 trispecific proteins, the binding affinities of the anti-DLL3 trispecific proteins toward human and cynomolgus monkey DLL3 proteins were measured, using a method where the DLL3 proteins were expressed as human IgG1-Fc fusions and the measurements were carried out using an Octet instrument with anti-human Fc tips. The $K_D$ measurements were made using a single 50 nM concentration of the anti-DLL3 trispecific proteins, which allowed for rank ordering based on potency. The relative affinities, measured as described above, are listed in Table 1. All of the sequences were found to bind human DLL3, with relative affinities ($K_D$) ranging from 0.5 to 42 nM. Some of the sequences were found to bind cynomolgus DLL3 with similar affinities to human DLL3, and the relative affinities for the binding of those sequences to cynomolgus DLL3 are also shown in Table 1.

The conditioned media were also tested in a T-cell dependent cellular cytotoxicity assay (see Nazarian A A, Archibeque I L, Nguyen Y H, Wang P, Sinclair A M, Powers D A. 2015. J Biomol Screen. 20:519-27). In this assay, luciferase labelled DMS-153 cells (small-cell lung carcinoma cell line; ATCC No. ATCC® CRL-2064™) were combined with purified human T cells, from a donor, and a titration of the anti-DLL3 trispecific proteins being tested.

It was hypothesized that if an anti-DLL3 trispecific protein directed T cells to kill the DLL3-expressing DMS-153 cells, then the viability of the DMS-153 cells, as determined by running a luciferase assay at 48 hours after starting the experiment, should decrease.

Figure 2:
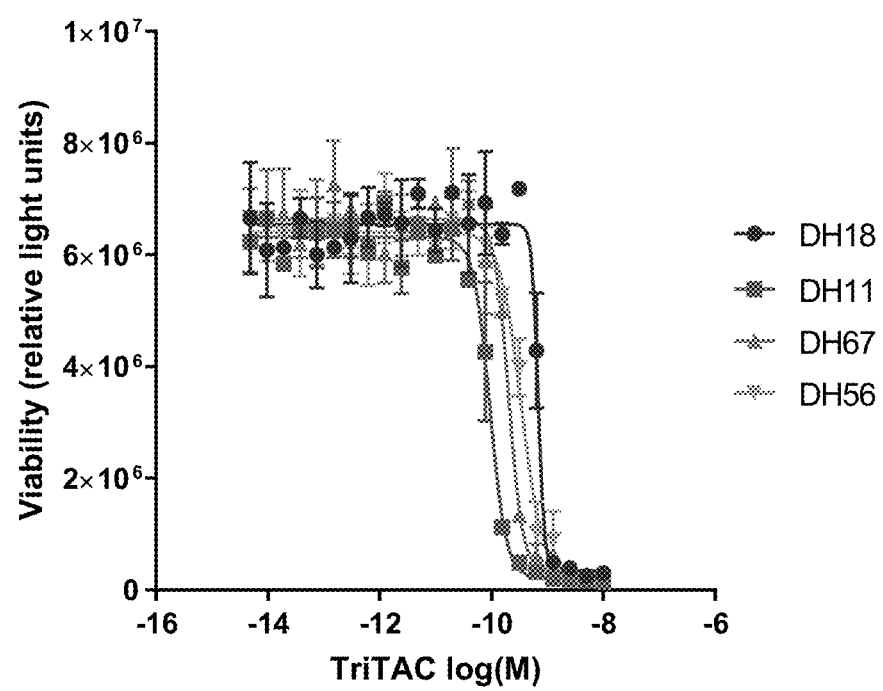
FIG. 2 illustrates results of a T cell dependent cellular cytotoxicity (TDCC) assay on DMS-153 cells, using exemplary DLL3 targeting trispecific proteins containing DLL3 binding domains of this disclosure, DH18, DH11, DH67, and DH56.
Figure 3:
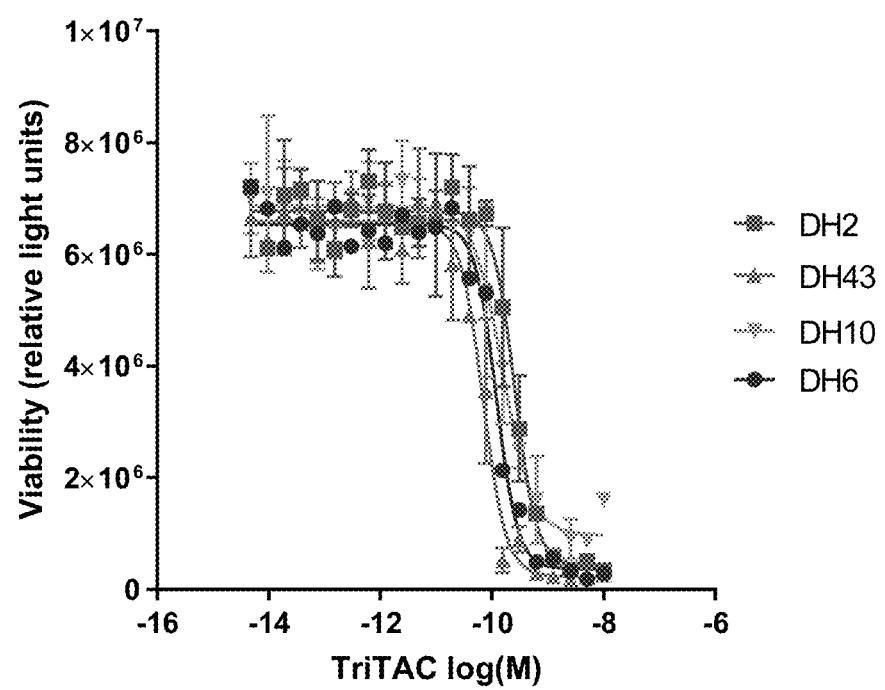
FIG. 3 illustrates results of a TDCC assay on DMS-153 cells, using exemplary DLL3 targeting trispecific proteins containing exemplary DLL3 binding domains of this disclosure DH2, DH43, DH10, and DH6.
Figure 4:
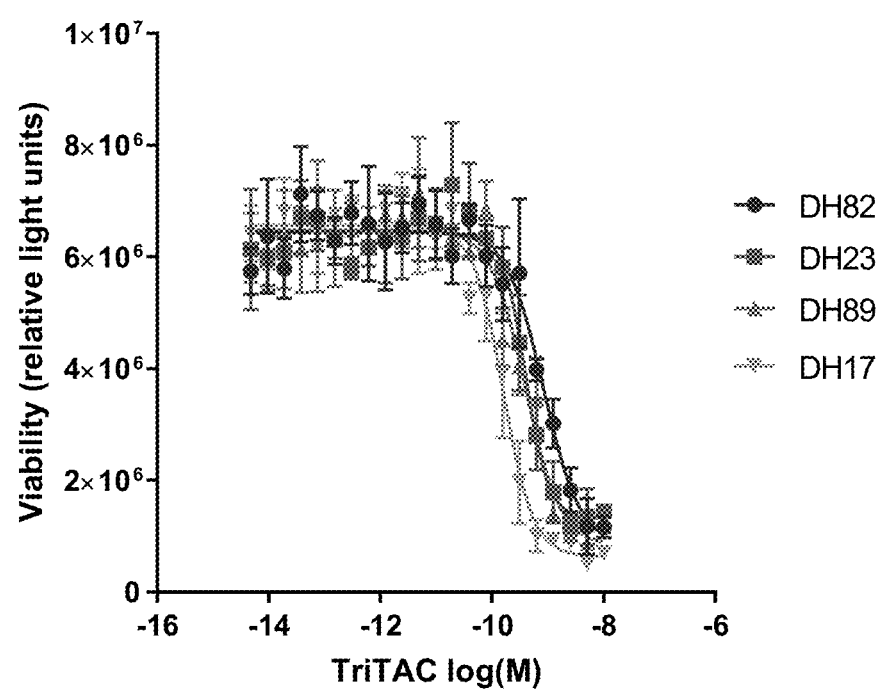
FIG. 4 illustrates results of a TDCC assay on DMS-153 cells, using exemplary DLL3 targeting trispecific proteins containing exemplary DLL3 binding domains of this disclosure DH82, DH23, DH89, and DH17.
Figure 5:
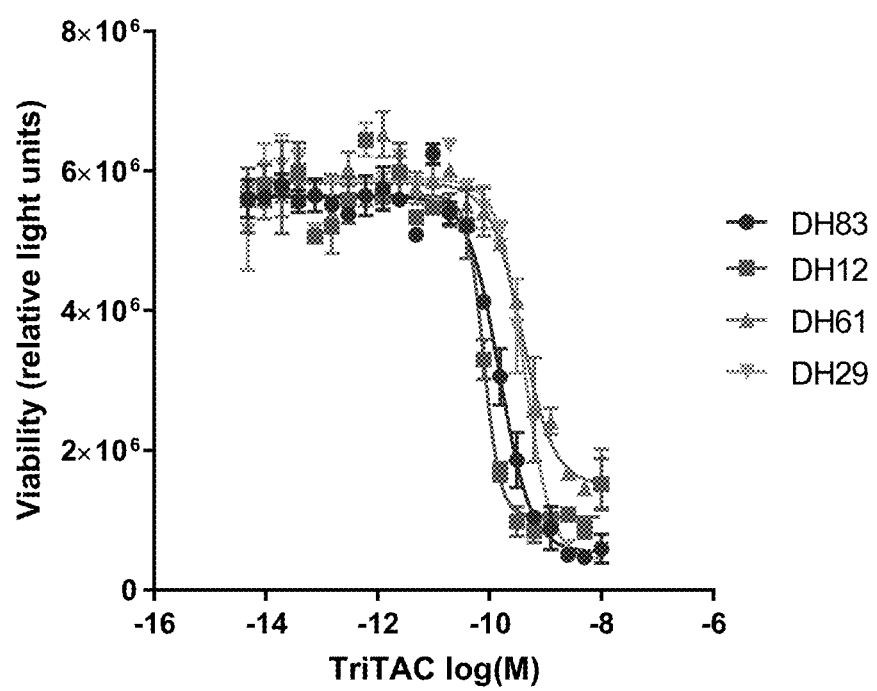
FIG. 5 illustrates results of a TDCC assay on DMS-153 cells, using exemplary DLL3 targeting trispecific proteins containing exemplary DLL3 binding domains of this disclosure DH83, DH12, DH61, and DH29.
Figure 6:
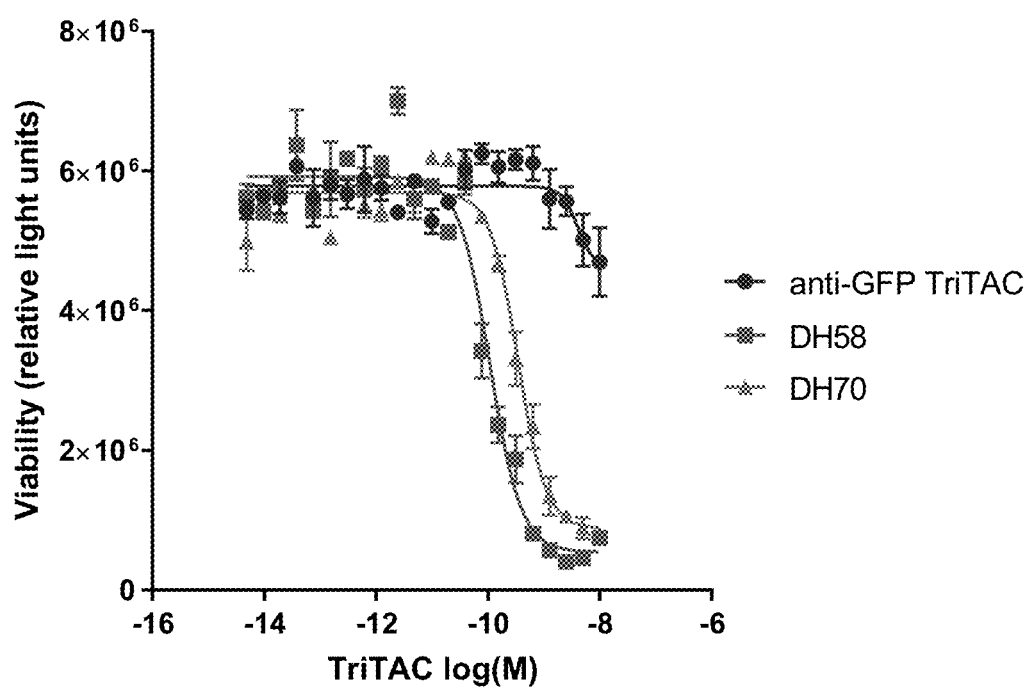
FIG. 6 illustrates results of a TDCC assay on DMS-153 cells, using exemplary DLL3 targeting trispecific proteins containing exemplary DLL3 binding domains of this disclosure DH58, and DH70, and a control trispecific protein.
Figure 7:
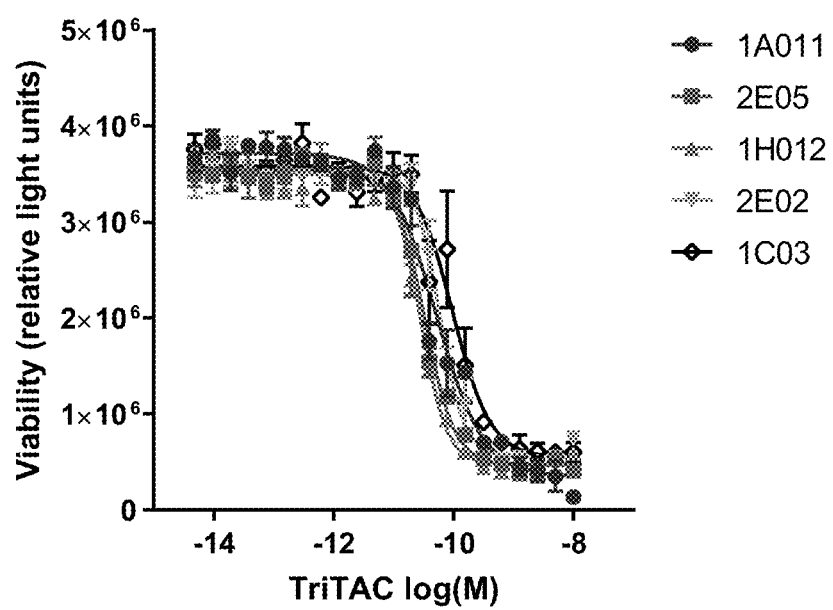
FIG. 7 illustrates results of a TDCC assay on DMS-153 cells, using exemplary affinity matured DLL3 targeting trispecific proteins containing exemplary DLL3 targeting domains of this disclosure 1A011, 2E05, 1H012, 2E02, and 1C03.
Figure 8:
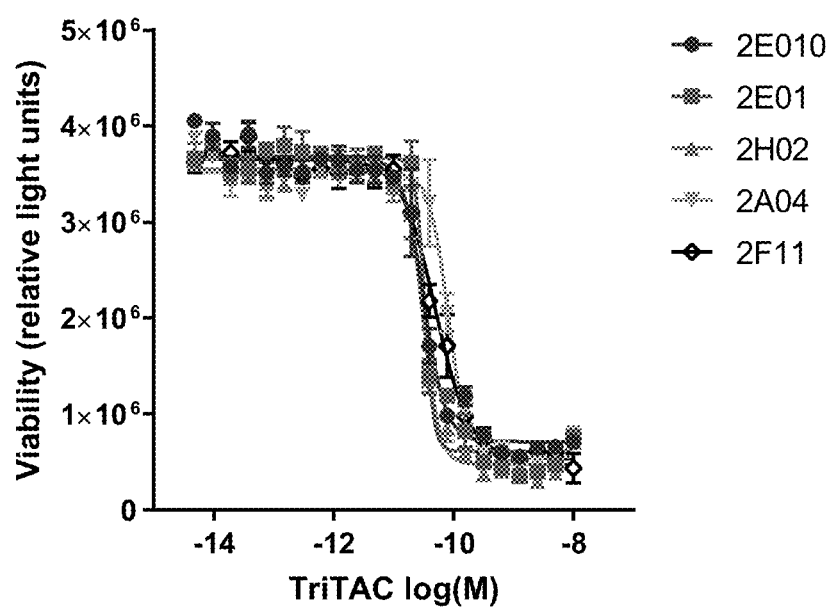
FIG. 8 illustrates results of a TDCC assay on DMS-153 cells, using exemplary affinity matured DLL3 binding trispecific proteins containing exemplary DLL3 targeting domains of this disclosure 2E010, 2E01, 2H02, 2A04, and 2F11.
Figure 9:
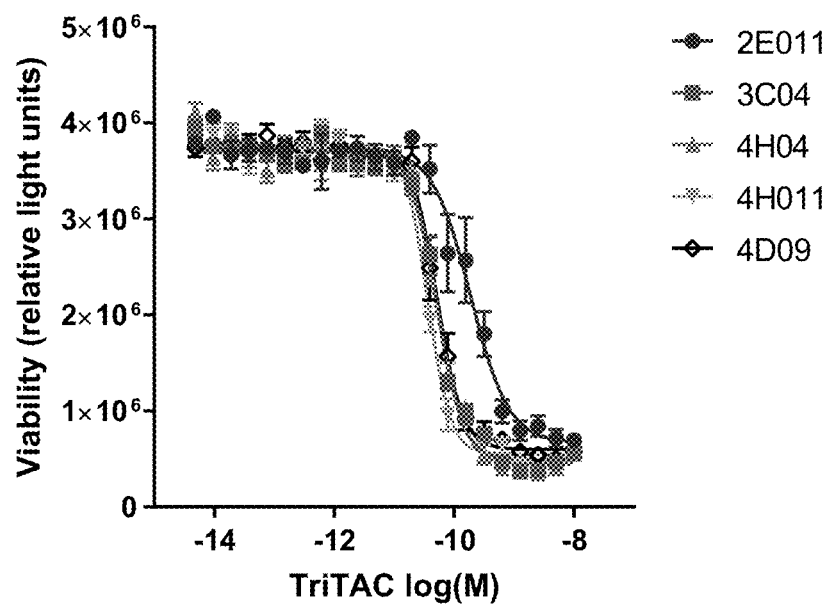
FIG. 9 illustrates results of a TDCC assay on DMS-153 cells, using exemplary affinity matured DLL3 binding trispecific proteins containing exemplary DLL3 targeting domains of this disclosure 2E011, 3C04, 4H04, 4H011, and 4D09.
Figure 10:
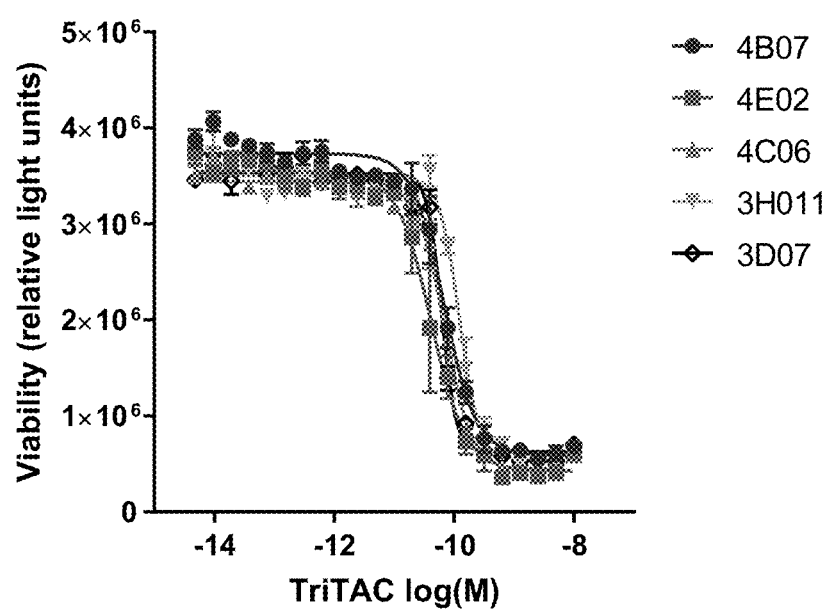
FIG. 10 illustrates results of a TDCC assay on DMS-153 cells, using exemplary affinity matured DLL3 binding trispecific proteins containing exemplary DLL3 targeting domains of this disclosure 4B07, 4E02, 4C06, 3H011, and 3D07.

As illustrated in FIGS. 2-6, which show graphs of representative TDCC data, several exemplary anti-DLL3 trispecific proteins were able to decrease the viability of the DMS-153 cells. FIG. 2 shows results of the TDCC assay for anti-DLL3 trispecific proteins comprising DLL3 binding domains DH18 (SEQ ID No. 59), DH11 (SEQ ID No. 55), DH67 (SEQ ID No. 42), and DH56 (SEQ ID No. 73). FIG. 3 shows results of the TDCC assay for anti-DLL3 trispecific proteins comprising DLL3 binding domains DH2 (SEQ ID No. 60), DH43 (SEQ ID No. 68), DH10 (SEQ ID No. 54), and DH6 (SEQ ID No. 75). FIG. 4 shows results of the TDCC assay for DLL3 trispecific protein comprises DLL3 binding domains DH82 (SEQ ID No. 81), DH23 (SEQ ID No. 62), DH89 (SEQ ID No. 84), and DH17 (SEQ ID No. 58). FIG. 5 shows results of the TDCC assay for DLL3 trispecific protein comprises DLL3 binding domains DH83 (SEQ ID No. 82), DH12 (SEQ ID No. 56), DH61 (SEQ ID No. 76), and DH29 (SEQ ID No. 64). FIG. 6 shows results of the TDCC assay for DLL3 trispecific protein comprises DLL3 binding domains DH58 (SEQ ID No. 74) and DH70 (SEQ ID No. 79). A negative control for the TDCC assays was a trispecific protein targeting GFP instead of DLL3 (as shown in FIG. 6) which did not direct the T cells to kills the DMS-153 cells. $EC_{50}$ values from the TDCC assay are also listed in Table 1. These values ranged from 69 pM to 11 nM.

TABLE 1

Activity of Humanized Anti-DLL3 Trispecific Proteins in DMS-153 TDCC Assays and Their Affinities for Human and Cynomolgus DLL3 Protein. The $K_D$ measurements were made using a single concentration of anti-DLL3 trispecific protein. The TDCC assay was performed using human T cells.

| DLL3 binder | DMS-153 TDCC EC50 (M) | huDLL3 KD (nM) | cyDLL3 KD (nM) |
| --- | --- | --- | --- |
| DH43 | 6.9E-11 | 4.3 | 5.5 |
| DH12 | 7.8E-11 | 1.3 | n/d |
| DH11 | 9.3E-11 | 5.3 | 5.6 |
| DH58 | 1.1E-10 | 3.3 | 27.9 |
| DH6 | 1.2E-10 | 6.1 | 6.8 |
| DH83 | 1.5E-10 | 4.7 | n/d |
| DH10 | 1.6E-10 | 3.9 | 25.0 |
| DH17 | 1.6E-10 | 7.0 | n/d |
| DH67 | 2.0E-10 | 8.4 | 8.2 |
| DH2 | 2.6E-10 | 6.5 | 14.6 |
| DH56 | 3.4E-10 | 8.1 | 8.0 |
| DH70 | 3.4E-10 | 16.2 | 86.2 |

TABLE 1-continued

Activity of Humanized Anti-DLL3 Trispecific Proteins in DMS-153 TDCC Assays and Their Affinities for Human and Cynomolgus DLL3 Protein. The $K_D$ measurements were made using a single concentration of anti-DLL3 trispecific protein. The TDCC assay was performed using human T cells.

| DLL3 binder | DMS-153 TDCC EC50 (M) | huDLL3 KD (nM) | cyDLL3 KD (nM) |
| --- | --- | --- | --- |
| DH61 | 3.8E−10 | 10.6 | 30.8 |
| DH89 | 4.0E−10 | 6.9 | n/d |
| DH23 | 4.0E−10 | 9.9 | n/d |
| DH29 | 4.2E−10 | 5.6 | n/d |
| DH5 | 5.2E−10 | 0.5 | 5.5 |
| DH18 | 6.4E−10 | 1.0 | 5.9 |
| DH45 | 6.9E−10 | 1.9 | 2.8 |
| DH82 | 8.4E−10 | 6.6 | n/d |
| DH80 | 1.0E−09 | 0.8 | 5.5 |
| DH27 | 1.2E−09 | 2.1 | 11.3 |
| DH69 | 1.4E−09 | 1.2 | 7.0 |
| DH92 | 1.7E−09 | 18.0 | 17.5 |
| DH94 | 1.8E−09 | 2.6 | 9.6 |
| DH42 | 1.8E−09 | 4.3 | 11.7 |
| DH1 | 2.0E−09 | 3.5 | 10.7 |
| DH38 | 2.9E−09 | 11.9 | n/d |
| DH51 | 3.8E−09 | 5.1 | 18.2 |
| DH54 | 4.5E−09 | 20.6 | 42.4 |
| DH3 | 6.2E−09 | 41.9 | n/d |
| DH15 | 2.0E−08 | 17.4 | n/d |
| DH22 | 2.8E−08 | 6.8 | 16.4 |
| DH84 | 1.1E−08 | 15.2 | 17.9 | n/d indicates binding was not detected.

Example 3: Screening of Phage Display Library for Identification of DLL3 Binding Domains with Higher Binding Affinities, Using Two Humanized DLL3 Single Domain Antibodies from Previous Example Two of the humanized antibody sequences, DH43 (SEQ ID No. 68) and DH6 (SEQ ID No. 75), were used as a starting point for making phage display libraries (following a method as described in WO2016187101A2). The anti-DLL3 sequences from this panning were subsequently cloned into an expression vector, in an expression construct comprising a signal domain followed by an anti-DLL3 heavy chain only variable domain followed by a GGGGSGGGS linker (SEQ ID No. 1808) followed by an anti-human albumin single domain antibody domain followed by a GGGGSGGGS linker (SEQ ID No. 1808) followed by an anti-human CD3 antibody fragment followed by a HHHHHH tag (SEQ ID No. 1819), to generate anti-DLL3 trispecific proteins. These constructs were transfected into EXPI293™ cells, and the expressed anti-DLL3 trispecific proteins were quantitated as described in Example 2. The sequences of the clones identified from the panning are SEQ ID Nos. 87 to 367. Table 2 provides CDR variations obtained in the DH43 DLL3 binder sequences after phage display selection. Three of the clones identified from the panning, SEQ ID Nos. 199 (2E05), 330 (4D09), and 365 (4H011) were engineered to generate variants, where each variant had a single amino acid change from the parental sequence, for example, to remove potential metabolic liabilities of the parental sequence. In particular, the DLL3 binding domains comprising SEQ ID Nos. 227 (2E05-M106Y), 228 (2E05-M106Q) were engineered variants of SEQ ID No. 199 (2E05); SEQ ID No. 366 (4D09-M34L) was an engineered variant of SEQ ID No. 330 (4D09); and SEQ ID No. 367 (4H11-M34L) was an engineered variant of SEQ ID No. 365 (4H011). The CDR1 sequences of these DLL3 binding clones identified by the panning are SEQ ID Nos. 529 to 809, the CDR2 sequences of the clones identified by the panning are SEQ ID Nos. 971 to 1251, and the CDR3 sequences of the clones identified by the panning are SEQ ID Nos. 1413 to 1691.

TABLE 2

Variants in CDR sequences by amino acid position of DH43 and its derivatives

| CDR | Amino acid position | CDR Amino acid Variants |
| --- | --- | --- |
| CDR1 | 26 | G |
|  | 27 | A, E, F, G, I, K, L, N, Q, R, S, T, V, Y |
|  | 28 | A, G, I, K, P, R, S, T, V |
|  | 29 | A, D, F, K, L, N, P, Q, R, S, T, Y |
|  | 30 | A, D, F, H, I, K, L, M, N, P, R, S, T, V, Y |
|  | 31 | F, I, K, L, M, N, R, S, T, V |
|  | 32 | N |
|  | 33 | A, G |
|  | 34 | F, I, L, M, T, V, Y |
|  | 35 | A, G |
|  | 36 | W |
| CDR2 | 50 | G |
|  | 51 | I, V |
|  | 52 | S |
|  | 53 | A, K, P, R, S |
|  | 54 | D, N |
|  | 55 | D, E, G, K, N, Q, R, S, T, Y |
|  | 56 | S, T |
|  | 57 | A, E, F, H, I, K, L, N, Q, R, S, T, V, Y |
|  | 58 | A, I, L, M, V, Y |
|  | 59 | D, F, H, I, L, N, S, T, V, Y |
|  | 60 | A, D, E, F, G, I, K, L, N, Q, R, S, T, V, Y |
|  | 61 | A, D, E, G, K, Q, S, V |
|  | 62 | S |
|  | 63 | A, V |
|  | 64 | K |
|  | 65 | G, V |
| CDR3 | 98 | F, Y |
|  | 99 | G, H, I, K, N, R, S, T |
|  | 100 | A, F, H, I, K, L, M, N, P, Q, R, S, T, Y |
|  | 101 | A, E, F, G, H, I, K, L, M, N, Q, R, S, T, V, Y |
|  | 102 | A, C, D, E, G, H, I, K, L, N, P, Q, R, S, T, W, Y |
|  | 103 | G, K, L, R, T |
|  | 104 | A, G, H, L, Q, R, S, T, V, Y |
|  | 105 | A, D, E, G, H, P, Q, S, T, W, Y |
|  | 106 | A, G, I, K, L, M, N, Q, R, S, T, V, Y |
|  | 107 | A, G, K, P, R, S, T, V |
|  | 108 | A, F, S, Y |

Using the conditioned medium with known concentrations of the anti-DLL3 trispecific proteins, the binding affinities of the anti-DLL3 trispecific proteins toward human DLL3 protein were measured using a method where biotinylated version of human DLL3 protein were expressed as a human IgG1 fusion protein, and the binding affinity measurement was carried out in an Octet instrument with streptavidin tips. The $K_D$ measurements were made using a single 50 nM concentration of the anti-DLL3 trispecific proteins, which allowed for rank ordering potency. In this experiment, the relative $K_D$ values of the affinity matured clones ranged from 2.3 nM to 64 nM, as listed in Table 3. The parental binders DH43 and DH6, respectively, had $K_D$ values of 7.7±0.6 nM and 9.9±0.3 nM based on four samples of conditioned medium from four transfections.

For select DLL3 binder molecules identified in this round of panning, as well as for the parental DLL3 binders DH43 and DH6, more precise affinity measurements for human DLL3 were made using 60 nM, 20 nM, 6.67 nM, and 2.22 nM concentrations of the anti-DLL3 trispecific proteins. In addition, relative affinity measurements were made using only 60 nM of the anti-DLL3 trispecific proteins. Binding affinities determined from the more precise measurements of certain anti-DLL3 binding molecules are listed in Table 4 [1H012 (SEQ ID No. 162); 1A011 (SEQ ID No. 95); 2E05 (SEQ ID No. 199); 4H011 (SEQ ID No. 365); 3C04 (SEQ ID No. 251); 2E02 (SEQ ID No. 198); 2H02 (SEQ ID No. 221); 3A011(SEQ ID No. 238); 3A02 (SEQ ID No. 230); 4D09 (SEQ ID No. 330); DH43 (SEQ ID No. 68); and DH6(SEQ ID No. 75)]. In this study, the parental binder, DH43, had a $K_D$ value of 8.9 nM, whereas the highest affinity daughter molecule, 1H012 (SEQ ID No. 162), had an affinity of 2.9 nM. Furthermore, 1H012 (SEQ ID No. 162) retained an ability to bind to cynomolgus DLL3 as well. Also in this study, the parental binder, DH6, had a $K_D$ value of 9.0 nM, whereas the highest affinity daughter molecule, 4H011 (SEQ ID No. 365), had an affinity of 3.9 nM. Furthermore, 4H011(SEQ ID No. 365) retained an ability to bind to cynomolgus DLL3 as well.

Figure 11:
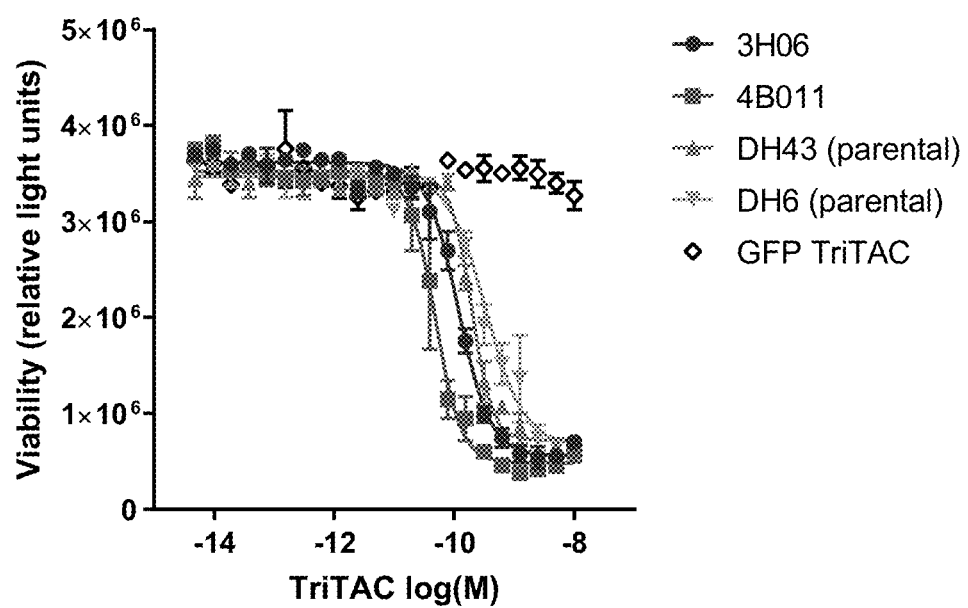
FIG. 11 illustrates results of a TDCC assay on DMS-153 cells, using exemplary affinity matured DLL3 targeting trispecific proteins containing exemplary DLL3 binding domains of this disclosure 3H06, and 4B011, and parental DLL binder domains DH43, DH6, and a control trispecific protein.
Figure 12:
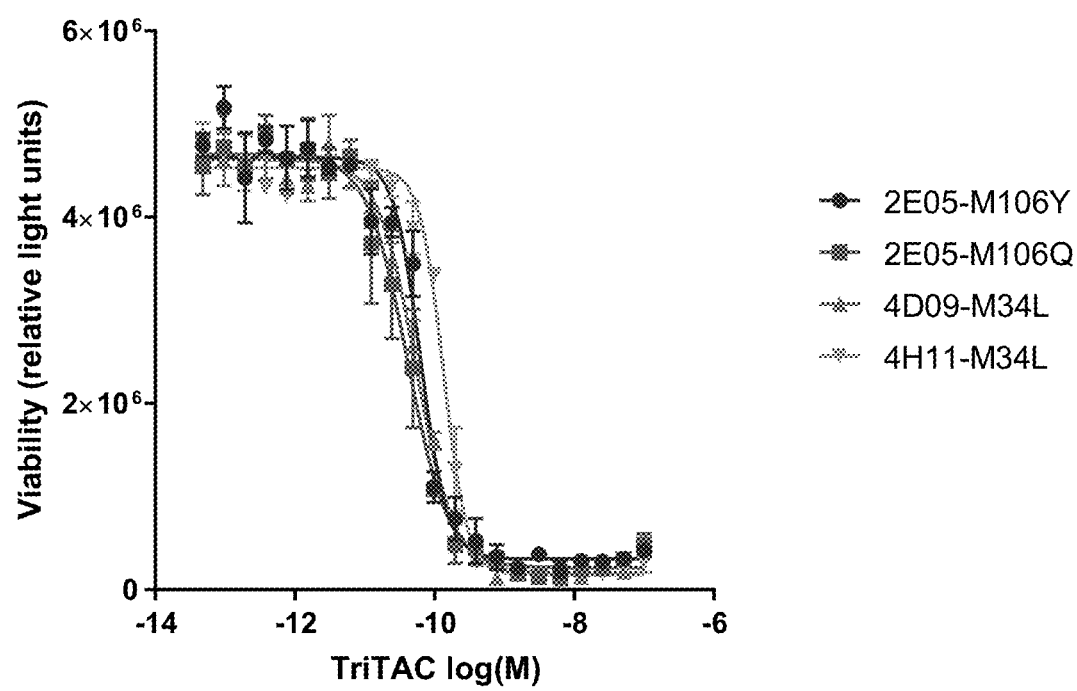
FIG. 12 illustrates results of a TDCC assay on DMS-153 cells, using exemplary purified affinity matured CHO expressed DLL3 binding trispecific proteins containing exemplary DLL3 targeting domains of this disclosure 2E05-M106Y, 2E05-M106Q, 4D09-M34L, and 4H11-M34L.
Figure 13:
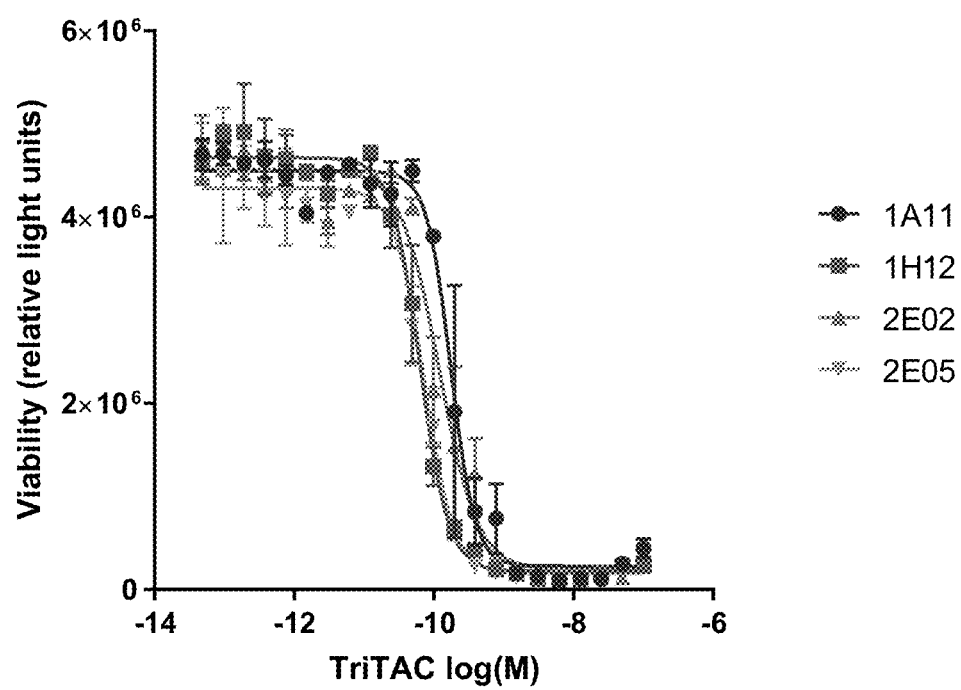
FIG. 13 illustrates results of a TDCC assay on DMS-153 cells, using exemplary purified affinity matured CHO expressed DLL3 targeting trispecific proteins containing exemplary DLL3 binding domains of this disclosure 1A011 (labelled as 1A11 on FIG. 13), 1H012 (labelled as 1H12 on FIG. 13), 2E02, and 2E05.
Figure 14:
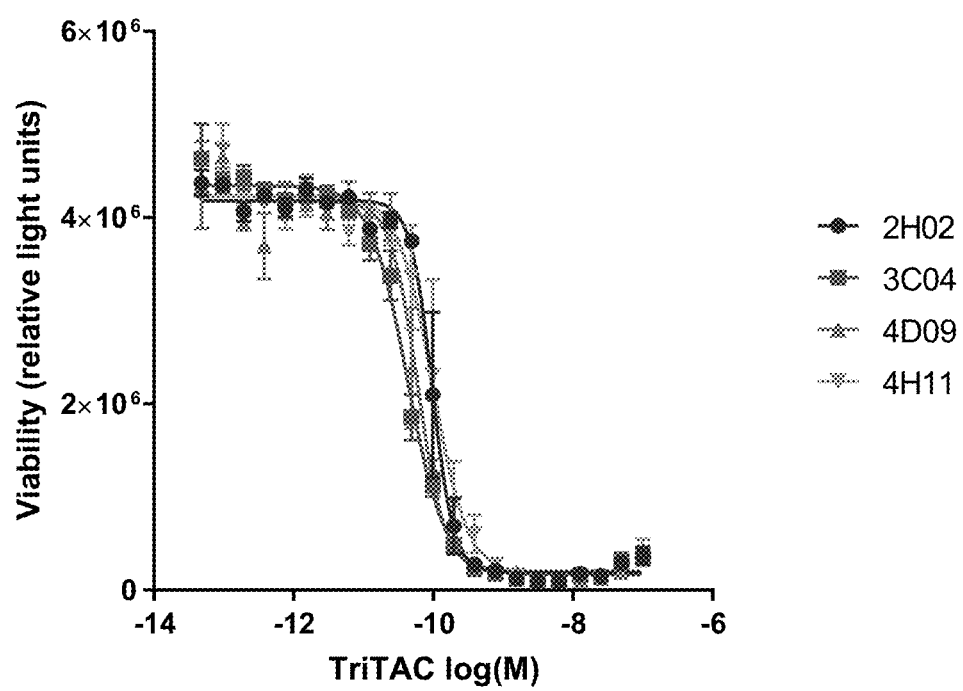
FIG. 14 illustrates results of a TDCC assay on DMS-153 cells, using exemplary purified affinity matured CHO expressed DLL3 targeting trispecific proteins containing exemplary DLL3 binding domains of this disclosure 2H02, 3C04, 4D09, and 4H11.
Figure 15:
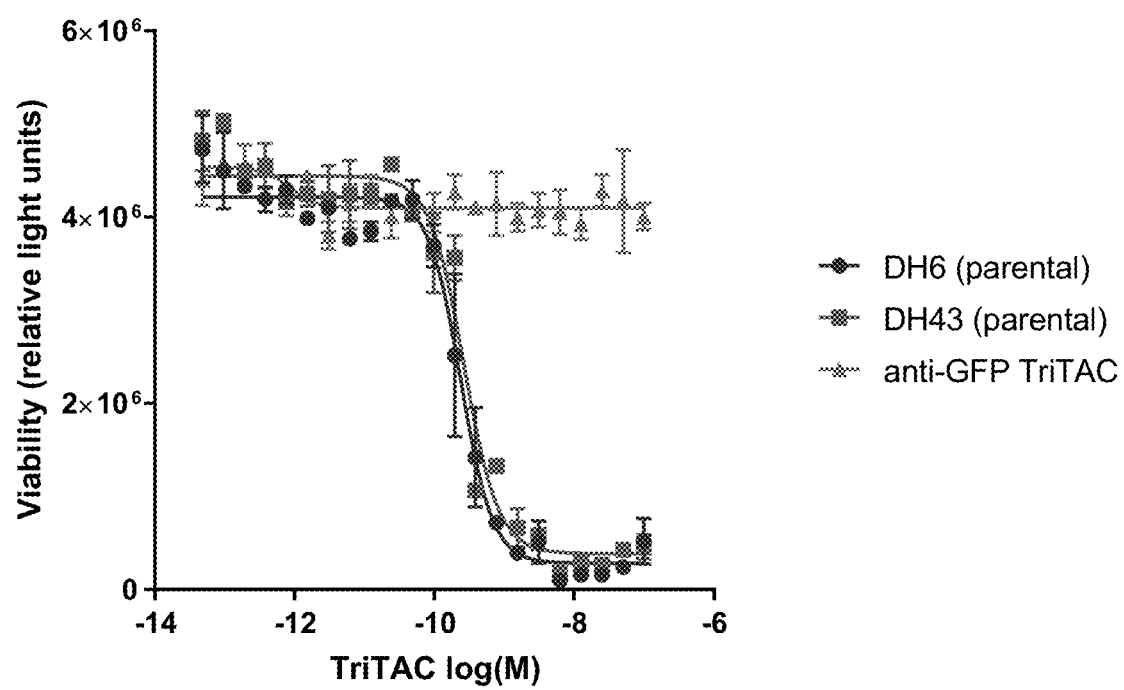
FIG. 15 illustrates results of a TDCC assay on DMS-153 cells, using exemplary purified DLL3 targeting trispecific proteins containing parental exemplary DLL3 binding domains DH43 and DH6, and a control trispecific protein that targets GFP.

Twenty-two DLL3 binder molecules identified in this round of panning were selected for testing in a TDCC assay with DMS-153 cells, using the same protocol as described in Example 2. Exemplary TDCC data are plot as graphs in FIGS. 7-11, and a summary of the $EC_{50}$ values are listed in Table 5. In this experiment, the parental DLL3 molecules, DH43 and DH6, had $EC_{50}$ values of 200 nM and 340 nM, respectively. The most potent daughter molecule of DH43 was 1H012 (SEQ ID No. 162), with an $EC_{50}$ value of 28 nM, demonstrating greater than 7-fold increase in TDCC potency compared to the parental DLL3 binder DH43. The most potent daughter molecule of DH6 was 4H011 (SEQ ID No. 365) with an $EC_{50}$ value of 36 nM, thereby showing greater than 8-fold increase in TDCC potency, compared to the parental DLL3 binder molecule. A control trispecific protein targeting GFP, used as a control, had no activity in this assay (as shown in FIG. 11).

TABLE 3

Relative Affinities of Anti-DLL3 Trispecific Proteins

| Name | $K_D$ (M) |
|---|---|
| 4A010 | 2.3E−09 |
| 2E011 | 2.4E−09 |
| 1C010 | 2.5E−09 |
| 3H011 | 2.7E−09 |
| 1E011 | 2.7E−09 |
| 1H012 | 3.5E−09 |
| 4G01 | 3.6E−09 |
| 1A011 | 3.7E−09 |
| 4D01 | 3.7E−09 |
| 4E02 | 3.8E−09 |
| 2E05 | 3.9E−09 |
| 4B011 | 3.9E−09 |
| 1F02 | 4.0E−09 |
| 1A05 | 4.0E−09 |
| 2A011 | 4.0E−09 |
| 2E010 | 4.0E−09 |
| 2C02 | 4.1E−09 |
| 2E01 | 4.1E−09 |
| 2G08 | 4.1E−09 |
| 1C01 | 4.3E−09 |
| 4B07 | 4.3E−09 |
| 1E09 | 4.4E−09 |
| 2H02 | 4.4E−09 |
| 3F010 | 4.4E−09 |
| 1D011 | 4.4E−09 |
| 3C04 | 4.5E−09 |
| 4H011 | 4.5E−09 |
| 4D09 | 4.7E−09 |
| 1A012 | 4.9E−09 |
| 2D012 | 4.9E−09 |
| 3C03 | 4.9E−09 |

TABLE 3-continued

Relative Affinities of Anti-DLL3 Trispecific Proteins

| Name | $K_D$ (M) |
|---|---|
| 1F011 | 5.0E−09 |
| 2H011 | 5.0E−09 |
| 1D010 | 5.0E−09 |
| 4C01 | 5.1E−09 |
| 1B01 | 5.2E−09 |
| 1D09 | 5.2E−09 |
| 1E012 | 5.3E−09 |
| 3D011 | 5.3E−09 |
| 1C05 | 5.3E−09 |
| 2H03 | 5.3E−09 |
| 1B09 | 5.4E−09 |
| 4B09 | 5.4E−09 |
| 2D011 | 5.4E−09 |
| 2A04 | 5.6E−09 |
| 1A06 | 5.6E−09 |
| 4A011 | 5.6E−09 |
| 2G03 | 5.6E−09 |
| 2B07 | 5.7E−09 |
| 1B011 | 5.7E−09 |
| 1H01 | 5.7E−09 |
| 1E010 | 5.7E−09 |
| 4F010 | 5.8E−09 |
| 1D01 | 5.8E−09 |
| 1F05 | 5.8E−09 |
| 1D03 | 5.8E−09 |
| 4D011 | 5.8E−09 |
| 1F012 | 5.8E−09 |
| 3C08 | 5.9E−09 |
| 2F03 | 5.9E−09 |
| 4D08 | 5.9E−09 |
| 3D07 | 5.9E−09 |
| 2D07 | 6.0E−09 |
| 2E02 | 6.0E−09 |
| 4C011 | 6.0E−09 |
| 2C08 | 6.1E−09 |
| 1C03 | 6.1E−09 |
| 2H07 | 6.1E−09 |
| 4H04 | 6.1E−09 |
| 1C02 | 6.2E−09 |
| 2C07 | 6.2E−09 |
| 1H011 | 6.2E−09 |
| 1H07 | 6.2E−09 |
| 2D04 | 6.2E−09 |
| 3A09 | 6.3E−09 |
| 2H04 | 6.3E−09 |
| 1F010 | 6.3E−09 |
| 1A03 | 6.3E−09 |
| 2C09 | 6.4E−09 |
| 2H010 | 6.4E−09 |
| 4D05 | 6.5E−09 |
| 2G07 | 6.5E−09 |
| 1A010 | 6.5E−09 |
| 2F09 | 6.5E−09 |
| 2B02 | 6.6E−09 |
| 4C03 | 6.6E−09 |
| 1A09 | 6.6E−09 |
| 2D06 | 6.6E−09 |
| 1G01 | 6.6E−09 |
| 2C06 | 6.7E−09 |
| 4C02 | 6.8E−09 |
| 2C04 | 6.8E−09 |
| 3A011 | 6.8E−09 |
| 1G011 | 6.8E−09 |
| 4C06 | 6.8E−09 |
| 2D03 | 6.8E−09 |
| 1B010 | 6.8E−09 |
| 1D06 | 6.8E−09 |
| 3G010 | 6.9E−09 |
| 4C010 | 7.0E−09 |
| 1E02 | 7.0E−09 |
| 1A01 | 7.0E−09 |
| 4B02 | 7.1E−09 |
| 1C07 | 7.1E−09 |
| 3F011 | 7.1E−09 |
| 1E07 | 7.1E−09 |
| 4E08 | 7.2E−09 |

TABLE 3-continued

Relative Affinities of Anti-DLL3 Trispecific Proteins

| Name | $K_D$ (M) |
|---|---|
| 3B05 | 7.2E−09 |
| 2B012 | 7.3E−09 |
| 3G09 | 7.3E−09 |
| 3B07 | 7.3E−09 |
| 2D010 | 7.3E−09 |
| 2B05 | 7.4E−09 |
| 4D06 | 7.5E−09 |
| 4G011 | 7.5E−09 |
| 4C07 | 7.5E−09 |
| 3F05 | 7.5E−09 |
| 2C010 | 7.6E−09 |
| 2B03 | 7.6E−09 |
| 4G08 | 7.6E−09 |
| 1C011 | 7.6E−09 |
| 2A08 | 7.7E−09 |
| 1A04 | 7.8E−09 |
| 3C09 | 7.8E−09 |
| 2H06 | 7.9E−09 |
| 2G09 | 8.0E−09 |
| 2F07 | 8.0E−09 |
| 1B05 | 8.0E−09 |
| 2A01 | 8.0E−09 |
| 3H06 | 8.0E−09 |
| 1E04 | 8.1E−09 |
| 1C04 | 8.1E−09 |
| 3A02 | 8.1E−09 |
| 2A03 | 8.2E−09 |
| 3G01 | 8.2E−09 |
| 4F011 | 8.2E−09 |
| 2D09 | 8.2E−09 |
| 3C05 | 8.2E−09 |
| 4C05 | 8.3E−09 |
| 1C06 | 8.3E−09 |
| 2D05 | 8.3E−09 |
| 1G07 | 8.3E−09 |
| 1H010 | 8.4E−09 |
| 2E09 | 8.5E−09 |
| 1C012 | 8.5E−09 |
| 1A07 | 8.6E−09 |
| 3H010 | 8.6E−09 |
| 4D04 | 8.6E−09 |
| 1B03 | 8.7E−09 |
| 4F09 | 8.8E−09 |
| 4G09 | 8.8E−09 |
| 3G04 | 8.8E−09 |
| 2A05 | 8.9E−09 |
| 2A06 | 8.9E−09 |
| 1F06 | 8.9E−09 |
| 1B07 | 8.9E−09 |
| 4H08 | 8.9E−09 |
| 4A02 | 9.0E−09 |
| 4F08 | 9.0E−09 |
| 4E010 | 9.0E−09 |
| 3H01 | 9.0E−09 |
| 3B011 | 9.0E−09 |
| 4A09 | 9.0E−09 |
| 4E09 | 9.1E−09 |
| 3C02 | 9.1E−09 |
| 2F01 | 9.2E−09 |
| 3A04 | 9.2E−09 |
| 1D012 | 9.3E−09 |
| 1E08 | 9.4E−09 |
| 4A05 | 9.4E−09 |
| 1F01 | 9.4E−09 |
| 2F02 | 9.6E−09 |
| 1D04 | 9.7E−09 |
| 4G05 | 9.7E−09 |
| 4F04 | 9.8E−09 |
| 4A07 | 9.8E−09 |
| 4G010 | 9.9E−09 |
| 4D010 | 9.9E−09 |
| 3H03 | 9.9E−09 |
| 3F06 | 9.9E−09 |
| 1D08 | 1.0E−08 |
| 2B010 | 1.0E−08 |
| 3B01 | 1.0E−08 |
| 3D01 | 1.0E−08 |
| 4A01 | 1.0E−08 |
| 2B01 | 1.0E−08 |
| 3C06 | 1.0E−08 |
| 1H02 | 1.0E−08 |
| 1G09 | 1.0E−08 |
| 4E06 | 1.0E−08 |
| 2F06 | 1.0E−08 |
| 2A09 | 1.0E−08 |
| 3E09 | 1.0E−08 |
| 1F04 | 1.0E−08 |
| 4B08 | 1.0E−08 |
| 2G04 | 1.1E−08 |
| 4B01 | 1.1E−08 |
| 1B02 | 1.1E−08 |
| 1B04 | 1.1E−08 |
| 2E06 | 1.1E−08 |
| 3E011 | 1.1E−08 |
| 4E01 | 1.1E−08 |
| 3D03 | 1.1E−08 |
| 4E07 | 1.1E−08 |
| 1G04 | 1.1E−08 |
| 3E04 | 1.1E−08 |
| 2B011 | 1.1E−08 |
| 3E02 | 1.2E−08 |
| 3D02 | 1.2E−08 |
| 3A010 | 1.2E−08 |
| 2C01 | 1.2E−08 |
| 3G06 | 1.2E−08 |
| 3B010 | 1.2E−08 |
| 3A03 | 1.2E−08 |
| 3F09 | 1.2E−08 |
| 4B04 | 1.2E−08 |
| 3G08 | 1.2E−08 |
| 3A08 | 1.2E−08 |
| 3B02 | 1.2E−08 |
| 4F03 | 1.2E−08 |
| 1B08 | 1.2E−08 |
| 2G011 | 1.3E−08 |
| 3G07 | 1.3E−08 |
| 4E011 | 1.3E−08 |
| 3H07 | 1.3E−08 |
| 1F07 | 1.3E−08 |
| 4H03 | 1.3E−08 |
| 4A06 | 1.3E−08 |
| 3F03 | 1.3E−08 |
| 3C011 | 1.4E−08 |
| 1D02 | 1.4E−08 |
| 1H06 | 1.4E−08 |
| 2D02 | 1.4E−08 |
| 1E05 | 1.4E−08 |
| 1G05 | 1.4E−08 |
| 3D010 | 1.4E−08 |
| 3F08 | 1.4E−08 |
| 3H09 | 1.4E−08 |
| 3C01 | 1.4E−08 |
| 3A05 | 1.5E−08 |
| 4F02 | 1.5E−08 |
| 4G02 | 1.5E−08 |
| 3B06 | 1.5E−08 |
| 4C08 | 1.6E−08 |
| 3A06 | 1.6E−08 |
| 3D05 | 1.6E−08 |
| 4H09 | 1.6E−08 |
| 4H07 | 1.6E−08 |
| 3A01 | 1.6E−08 |
| 3E01 | 1.6E−08 |
| 4B06 | 1.6E−08 |
| 1H08 | 1.7E−08 |
| 3G011 | 1.7E−08 |
| 3D08 | 1.7E−08 |
| 2E08 | 1.7E−08 |
| 4H06 | 1.8E−08 |
| 2H08 | 1.8E−08 |
| 4B05 | 1.8E−08 |
| 4G07 | 1.8E−08 |

TABLE 3-continued

Relative Affinities of Anti-DLL3 Trispecific Proteins

| Name | $K_D$ (M) |
|---|---|
| 3G02 | 2.0E−08 |
| 3E03 | 2.0E−08 |
| 2F08 | 2.0E−08 |
| 4G03 | 2.0E−08 |
| 3B09 | 2.0E−08 |
| 4H01 | 2.1E−08 |
| 3B04 | 2.4E−08 |
| 4A08 | 2.4E−08 |
| 1C08 | 2.5E−08 |
| 4D03 | 2.6E−08 |
| 1G06 | 2.6E−08 |
| 4D02 | 3.0E−08 |
| 1F08 | 3.1E−08 |
| 3D09 | 3.2E−08 |
| 4A04 | 3.5E−08 |
| 1F09 | 3.5E−08 |
| 4H05 | 6.4E−08 |

TABLE 4

Binding constants for human DLL3 determined using three different concentrations of anti-DLL3 Trispecific proteins and binding constants for cynomolgus DLL3 determine using a single concentration of anti-DLL3 Trispecific proteins

| Name | Human $K_D$ (nM) | Cynomolgus $K_D$ (nM) |
|---|---|---|
| 1H012 | 2.9 | 4.3 |
| 1A011 | 3.5 | 3.6 |
| 2E05 | 3.5 | 4.8 |
| 4H011 | 3.9 | 5.7 |
| 3C04 | 4.0 | 5.7 |
| 2E02 | 4.4 | 3.4 |
| 2H02 | 4.4 | 5.2 |
| 3A011 | 7.3 | 8.8 |
| 3A02 | 7.8 | 9.5 |
| 4D09 | 8.1 | 8.2 |
| DH43 | 8.9 | 8.5 |
| DH6 | 9.0 | 10 |

TABLE 5

DMS-153 TDCC values of affinity matured anti-DLL3 Trispecific protein in conditioned medium tested in triplicate using human T cells

| Name | $EC_{50}$ (M) |
|---|---|
| 1H012 | 2.8E−11 |
| 2H02 | 3.1E−11 |
| 2E010 | 3.1E−11 |
| 2E05 | 3.3E−11 |
| 2E01 | 3.3E−11 |
| 4H011 | 3.6E−11 |
| 4E02 | 4.1E−11 |
| 4B011 | 4.8E−11 |
| 2F11 | 4.9E−11 |
| 4H04 | 5.1E−11 |
| 1A011 | 5.1E−11 |
| 4D09 | 5.2E−11 |
| 3C04 | 5.2E−11 |
| 2E02 | 5.9E−11 |
| 3D07 | 6.1E−11 |
| 4B07 | 6.7E−11 |
| 4C06 | 6.8E−11 |
| 2A04 | 8.1E−11 |
| 1C03 | 9.6E−11 |
| 3H06 | 1.2E−10 |
| 3H011 | 1.2E−10 |

TABLE 5-continued

DMS-153 TDCC values of affinity matured anti-DLL3 Trispecific protein in conditioned medium tested in triplicate using human T cells

| Name | $EC_{50}$ (M) |
|---|---|
| 2E011 | 1.9E−10 |
| DH43 | 2.0E−10 |
| DH6 | 3.4E−10 |

Example 4: Cloning of Select DLL3 Binding Molecules from Example 3 into Mammalian Cells Anti-DLL3 trispecific proteins described in Example 3, as well as the parental DLL3 binder molecules were subcloned into a CHO cell expression vector and were stably transfected in CHO cells (see, Running Deer and Allison 2004. Biotechnol. Prog. 20: 880-889). The DLL3 binder molecules were: 2E05-M106Q (SEQ ID No. 228); 2C04 (SEQ ID No. 181); 4D09-M34L (SEQ ID No. 366); 4D09 (SEQ ID No. 330); 2E05-M106Y (SEQ ID No. 227); 1H012 (SEQ ID No.162) (also referred to herein as 1H12); 2E05 (SEQ ID No. 199); 2H02 (SEQ ID No. 221); 4D011 (SEQ ID No. 332) (also referred to herein as 4D11); 2E02 (SEQ ID No. 198); 4H11-M34L (SEQ ID No. 367); 1A011 (SEQ ID No. 95) (also referred to herein as 1A11); DH6 (SEQ ID No. 75); and DH43 (SEQ ID No. 68). The anti-DLL3 trispecific proteins were purified after expression in CHO cells, in conditioned medium from pools of stable clones, using protein A and ion exchange chromatography. The purified proteins were tested in TDCC assay using the same method as described in Example 2. The $EC_{50}$ values from the TDCC assay of the instant example are listed in Table 6, and the graphs of the data are in FIGS. 12-15. The most potent molecule, 2E05-M106Q (SEQ ID No. 228), had an $EC_{50}$ value of 41 nM, which is 6.6 fold more potent than the parental molecule, DH43. The most potent molecule derived from DH6 was 4D09-M34L (SEQ ID No. 366), which had an $EC_{50}$ value of 54 nM and is 4.4 fold more potent than the parental molecule, DH6.

TABLE 6

TDCC Activity of CHO Expressed and Purified Affinity Matured Anti-DLL3 Trispecific Proteins

| Name | $EC_{50}$ (M) |
|---|---|
| 2E05-M106Q | 4.10E−11 |
| 2C04 | 4.30E−11 |
| 4D09-M34L | 5.40E−11 |
| 4D09 | 6.00E−11 |
| 2E05-M106Y | 6.30E−11 |
| 1H12 | 6.30E−11 |
| 2E05 | 7.20E−11 |
| 2H02 | 9.60E−11 |
| 4D11 | 9.80E−11 |
| 2E02 | 1.20E−10 |
| 4H11-M34L | 1.30E−10 |
| 1A11 | 1.70E−10 |
| DH6 | 2.40E−10 |
| DH43 | 2.70E−10 |

Example 5: Affinity Maturation to Obtain Anti-DLL3 Binders of Improved Affinity

To obtain more potent anti-DLL3 binders, a second round of affinity maturation was performed. Phage display libraries were created based on the DH6 (SEQ ID No. 75) and DH58 (SEQ ID No. 74) parental sequences. The sequences for the binders from this round of affinity maturation are provided in SEQ ID Nos. 368 to 442. The CDR1 sequences of DLL3 binders identified in this round of affinity maturation are SEQ ID Nos. 810 to 884, the CDR2 sequences of DLL3 binders identified in this round of affinity maturation are SEQ ID Nos. 1252 to 1326, and the CDR3 sequences of DLL3 binders identified in this round of affinity maturation are SEQ ID Nos. 1692 to 1768. Table 7 provides CDR variations obtained in the DH6 DLL3 binder sequences after phage display selection.

The affinity matured anti-DLL3 sequences identified as above were cloned into an expression vector, in an expression construct comprising a signal domain followed by an anti-DLL3 sequence followed by a GGGGSGGGS linker (SEQ ID No. 1808) followed by anti-human albumin single domain antibody 10G (SEQ ID No. 1774) followed by a GGGGSGGGS linker (SEQ ID No. 1808) followed by anti-human CD3 antibody 2B2 (SEQ ID No.1793) followed by a HHHHHH tag (SEQ ID No. 1819), to generate anti-DLL3 trispecific constructs.

The anti-DLL3 trispecific constructs containing the affinity matured anti-DLL3 binding sequences were then transfected into EXPI293™ cells. These anti-DLL3 trispecific constructs were subsequently engineered with a protein A binding site, and the amount of anti-DLL3 trispecific construct in the conditioned media from the transfected EXPI293™ cells was quantitated using an Octet instrument with protein A tips. A control trispecific protein of similar molecular weight as the anti-DLL3 trispecific proteins was used as a standard.

Using the conditioned medium with known concentrations of the anti-DLL3 trispecific proteins, the relative binding affinities of the anti-DLL3 trispecific proteins toward human DLL3 protein were measured using a method where biotinylated version of human DLL3 protein were expressed as a human IgG1 fusion protein, and the binding affinity measurement was carried out in an Octet instrument with streptavidin tips. The $K_D$ measurements were made using a single 50 nM concentration of anti-DLL3 trispecific protein, which allowed for rank ordering potency. The measured affinities are listed in Table 8. All of the tested sequences were found to bind human DLL3, with $K_D$ values ranging from 0.3 nM to 34 nM.

Figure 16:
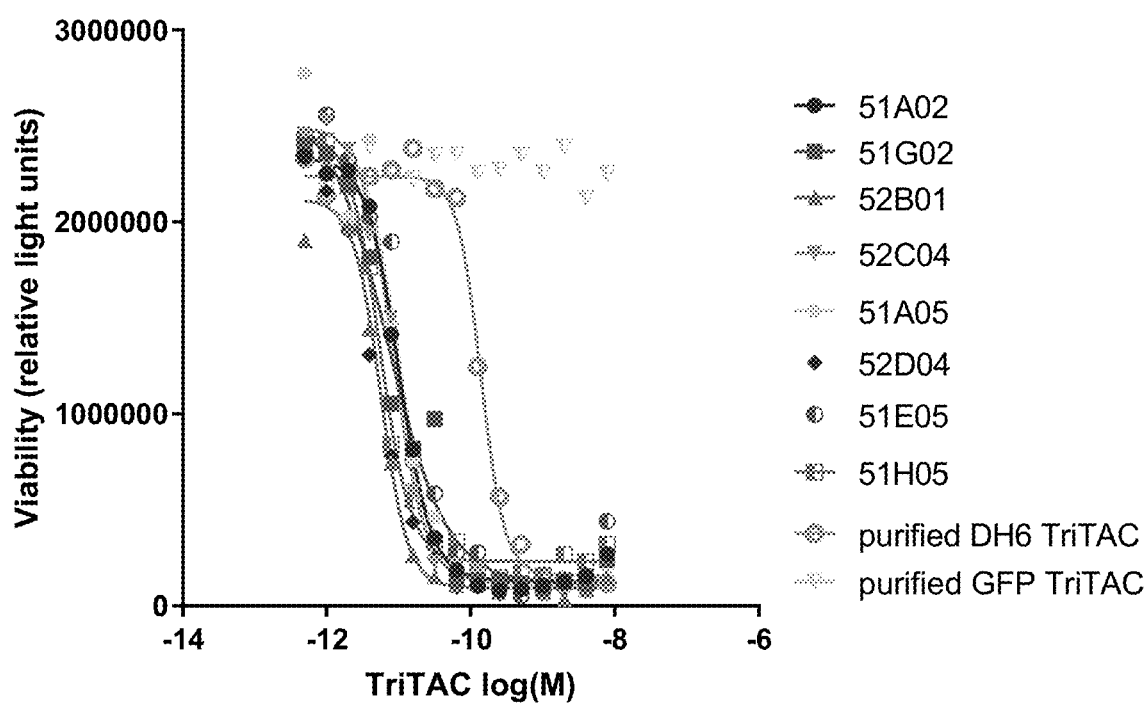
FIG. 16 illustrates results of a TDCC assay DMS-153 cells, using exemplary DLL3 targeting trispecific proteins containing exemplary DLL3 binding domains of this disclosure from second round of affinity maturation.

The conditioned medium was also tested in a T-cell dependent cellular cytotoxicity assay (see Nazarian A A, Archibeque I L, Nguyen Y H, Wang P, Sinclair A M, Powers D A. 2015. J Biomol Screen. 20:519-27). In this assay, luciferase labelled DMS-153 cells were combined with purified human T cells and a titration of anti-DLL3 trispecific proteins. It was hypothesized that if an anti-DLL3 trispecific protein directed T cells to kill the DLL3-expression DMS-153 cells, then the viability of the DMS-153 cells, as determined by running a luciferase assay at 48 hours after starting the experiment, should decrease. FIG. 16 illustrates a graph of representative TDCC data for anti-DLL3 trispecific proteins containing the following DLL3 binding domains: 51A02 (SEQ ID No. 409), 51G02 (SEQ ID No. 425), 52B01 (SEQ ID No. 430), 52C04 (SEQ ID No.431), 51A05 (SEQ ID No. 411), 52D04 (SEQ ID No. 432), 51E05 (SEQ ID No. 420), 51H05 (SEQ ID No. 429), and for purified DH43 protein (SEQ ID No. 68), and purified DH6 protein (SEQ ID No. 75). $EC_{50}$ values from the TDCC assay are listed in Table 9. The values ranged from 4.2 pM to 1.5 nM. A negative control for the TDCC assays was a trispecific protein targeting GFP (as shown in FIG. 16) which did not direct the T cells to kills the DMS-153 cells.

TABLE 7

Variants in CDR sequences by amino acid position of DH6 and its derivatives

| CDR | Amino acid position | CDR Amino acids |
|---|---|---|
| CDR1 | 26 | A, D, E, F, G, H, K, L, M, N, Q, R, S, V, W, Y |
|  | 27 | D, E, H, K, M, P, R, S, T, Y |
|  | 28 | A, D, G, H, K, N, P, Q, R, S, T, V, Y |
|  | 29 | K, S, V |
|  | 30 | A, F, G, H, K, L, M, N, Q, R, S, T, V, W, Y |
|  | 31 | D, F, H, I, K, L, M, N, Q, R, S, V, Y |
|  | 32 | L, M |
|  | 33 | S |
|  | 34 | I, L, M, S, T, V |
|  | 35 | A |
| CDR2 | 50 | G |
|  | 51 | I, V |
|  | 52 | S |
|  | 53 | A, D, E, G, H, I, K, L, N, P, Q, R, S, T, V, Y |
|  | 54 | A, D, E, G, H, N, R, T |
|  | 55 | G |
|  | 56 | H, P, R, S |
|  | 57 | A, H, I, K, M, N, Q, R, T, V |
|  | 58 | A, D, G, H, I, L, M, N, S, T, V, Y |
|  | 59 | Y |
|  | 60 | A, F, I, L, M, R, S, T, V, Y |
|  | 61 | A, D, E, G, H, K, L, N, R, S, V |
|  | 62 | S |
|  | 63 | V |
|  | 64 | K |
|  | 65 | G |
| CDR3 | 98 | L, Y |
|  | 99 | D, E, G, H, K, N, Q, R, S, T, V, Y |
|  | 100 | Q, W |
|  | 101 | A, D, E, G, H, I, K, L, M, P, R, S, T, V |
|  | 102 | A, D, E, G, N, R, S, T, Y |
|  | 103 | A, P, R, S |
|  | 104 | A, D, F, G, H, L, M, N, Q, R, S, T, V, Y |
|  | 105 | A, G, I, K, P, Q, R, S, T |
|  | 106 | F, H, Y |

TABLE 8

Binding constants for human DLL3 determined using a single concentration of anti-DLL3 Trispecific proteins

| Name | $K_D$ (nM) |
|---|---|
| 53A05 | 3.1E−10 |
| 53A04 | 4.2E−10 |
| 53C04 | 5.0E−10 |
| 52D04 | 5.0E−10 |
| 53B05 | 6.0E−10 |
| 51G10 | 6.0E−10 |
| 52B01 | 6.1E−10 |
| 51H05 | 6.7E−10 |
| 53B06 | 7.1E−10 |
| 54B05 | 7.6E−10 |
| 52C04 | 8.2E−10 |
| 42C03 | 8.8E−10 |
| 51A01 | 9.2E−10 |
| 51E05 | 9.7E−10 |
| 53A09 | 9.7E−10 |
| 51H04 | 1.0E−09 |
| 42A06 | 1.0E−09 |
| 41H03 | 1.0E−09 |
| 51A05 | 1.1E−09 |
| 42E05 | 1.2E−09 |
| 51A02 | 1.2E−09 |
| 42D08 | 1.3E−09 |
| 51G02 | 1.3E−09 |
| 42B10 | 1.3E−09 |

TABLE 8-continued

Binding constants for human DLL3 determined using a single concentration of anti-DLL3 Trispecific proteins

| Name | $K_D$ (nM) |
| --- | --- |
| 42G07 | 1.3E−09 |
| 41D01 | 1.4E−09 |
| 51F03 | 1.4E−09 |
| 42D06 | 1.5E−09 |
| 41H04 | 1.5E−09 |
| 51B01 | 1.6E−09 |
| 42C08 | 1.8E−09 |
| 42A03 | 1.9E−09 |
| 42A11 | 2.0E−09 |
| 42H08 | 2.1E−09 |
| 51A03 | 2.2E−09 |
| 42C11 | 2.3E−09 |
| 41C02 | 2.4E−09 |
| 51B11 | 2.4E−09 |
| 51F02 | 2.4E−09 |
| 42H05 | 2.7E−09 |
| 41D02 | 2.7E−09 |
| 42D05 | 2.7E−09 |
| 42E02 | 2.9E−09 |
| 42H11 | 3.1E−09 |
| 42A07 | 3.2E−09 |
| 42C10 | 3.2E−09 |
| 42B06 | 3.2E−09 |
| 42F08 | 3.2E−09 |
| 51D03 | 3.3E−09 |
| 41E02 | 3.4E−09 |
| 42G05 | 3.4E−09 |
| 51E02 | 3.5E−09 |
| 42C01 | 3.6E−09 |
| 42A08 | 3.6E−09 |
| 42E06 | 3.8E−09 |
| 42E07 | 3.9E−09 |
| 41G01 | 4.0E−09 |
| 42E01 | 4.0E−09 |
| 41D03 | 4.8E−09 |
| 41E01 | 5.3E−09 |
| 42D07 | 5.3E−09 |
| 42F01 | 5.5E−09 |
| 42C07 | 6.4E−09 |
| 51F04 | 6.7E−09 |
| 51E03 | 7.2E−09 |
| 51C02 | 7.5E−09 |
| 51D01 | 7.9E−09 |
| 41B11 | 9.9E−09 |
| 51B04 | 1.6E−08 |
| 51F01 | 1.6E−08 |
| 42F10 | 1.7E−08 |
| 51G04 | 2.1E−08 |
| 41F07 | 2.5E−08 |
| 41D07 | 3.4E−08 |

TABLE 9

DMS-153 TDCC values of affinity matured anti-DLL3 Trispecific Proteins in conditioned medium tested in triplicate using human T cells

| Name | TDCC $EC_{50}$ (M) |
| --- | --- |
| 52D04 | 4.2E−12 |
| 51H05 | 5.3E−12 |
| 52B01 | 5.5E−12 |
| 54B05 | 6.2E−12 |
| 53C04 | 6.2E−12 |
| 51G10 | 6.6E−12 |
| 51G02 | 6.8E−12 |
| 53B06 | 7.7E−12 |
| 52C04 | 8.2E−12 |
| 53A04 | 8.2E−12 |
| 51A02 | 9.5E−12 |

TABLE 9-continued

DMS-153 TDCC values of affinity matured anti-DLL3 Trispecific Proteins in conditioned medium tested in triplicate using human T cells

| Name | TDCC $EC_{50}$ (M) |
| --- | --- |
| 51A05 | 9.6E−12 |
| 53A09 | 9.7E−12 |
| 51E05 | 1.1E−11 |
| 51F03 | 1.1E−11 |
| 51H04 | 1.2E−11 |
| 53B05 | 1.2E−11 |
| 53H04 | 1.3E−11 |
| 53A05 | 1.6E−11 |
| 51B01 | 1.8E−11 |
| 42D08 | 1.9E−11 |
| 51A01 | 1.9E−11 |
| 41E02 | 2.1E−11 |
| 41D01 | 2.3E−11 |
| 42C03 | 2.5E−11 |
| 42A03 | 2.5E−11 |
| 42F10 | 2.5E−11 |
| 51B11 | 2.7E−11 |
| 42A07 | 2.8E−11 |
| 42G07 | 2.8E−11 |
| 42A06 | 2.8E−11 |
| 42F08 | 3.1E−11 |
| 42E05 | 3.4E−11 |
| 42C01 | 3.5E−11 |
| 42D05 | 3.6E−11 |
| 41C02 | 3.6E−11 |
| 51D03 | 3.8E−11 |
| 42H05 | 3.8E−11 |
| 51E02 | 3.8E−11 |
| 42C10 | 3.9E−11 |
| 42D06 | 4.0E−11 |
| 42H08 | 4.0E−11 |
| 42A11 | 4.2E−11 |
| 41D02 | 4.4E−11 |
| 42A08 | 4.5E−11 |
| 42E02 | 4.7E−11 |
| 41D03 | 4.8E−11 |
| 41G01 | 5.0E−11 |
| 42C11 | 5.3E−11 |
| 51A03 | 5.4E−11 |
| 42G05 | 5.9E−11 |
| 42B10 | 6.6E−11 |
| 42D07 | 8.5E−11 |
| 42F01 | 8.9E−11 |
| 42C08 | 9.4E−11 |
| 42E07 | 1.0E−10 |
| 42E01 | 1.0E−10 |
| 51C02 | 1.0E−10 |
| 42B06 | 1.1E−10 |
| 41E01 | 1.1E−10 |
| 51F04 | 1.2E−10 |
| 51F02 | 1.2E−10 |
| 42C07 | 1.3E−10 |
| 51D01 | 1.3E−10 |
| 42E06 | 1.8E−10 |
| 51F01 | 5.5E−10 |
| 51E03 | 1.4E−09 |
| 51B04 | 1.5E−09 |

Example 6: Affinity Maturation to Obtain Anti-DLL3 Binders of Improved Affinity

Certain anti-DLL3 trispecific proteins containing DLL-3 binding sequences that had the most potent TDCC activity in the assay described in Example 5, and an anti-DLL3 trispecific protein containing the parental DLL3 binder DH6, were subcloned into a CHO cell expression vector and were stably transfected in CHO cells (see Running Deer and Allison 2004. Biotechnol. Prog. 20: 880-889). The DLL3 binding sequences were: DH6 (SEQ ID No. 75); 51A2 (SEQ ID No. 408); 51A5 (SEQ ID No. 411); 51F3 (SEQ ID No.

Figure 17:
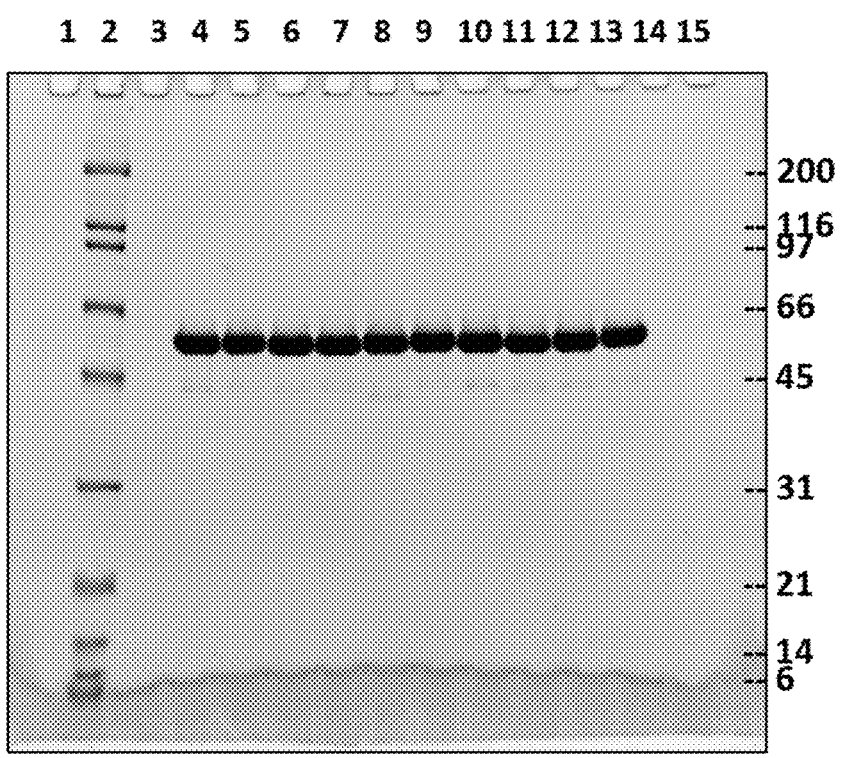
FIG. 17 illustrates an image of a 10-20% TRIS Glycine SDS-PAGE loaded with 2.4 micrograms of non-reduced protein per lane and stained with Coomassie. The lane numbers are indicated by the numbers at the top of the gel image and the migration of molecular weight standards are indicated by the number on the right side of the gel image (in kilodaltons). Gel loading: Lane 1 empty, lane 2 molecular weight standard, lane 3 empty, lane 4 anti-DLL3 trispecific containing DLL3 binding domain 51G2, lane 5 anti-DLL3 trispecific containing DLL3 binding domain 51G10, lane 6 anti-DLL3 trispecific containing DLL3 binding domain 51H5, lane 7 anti-DLL3 trispecific containing DLL3 binding domain 51X5, lane 8 anti-DLL3 trispecific containing DLL3 binding domain 52B1, lane 9 anti-DLL3 trispecific containing DLL3 binding domain 52C4, lane 10 anti-DLL3 trispecific containing DLL3 binding domain 52D4, lane 11 anti-DLL3 trispecific containing DLL3 binding domain 51A2, lane 12 containing DLL3 binding domain anti-DLL3 trispecific 51A5, lane 13 anti-DLL3 trispecific containing DLL3 binding domain 51F3, lane 14 empty, and lane 15 empty.

423); 51G2 (SEQ ID No. 425); 51G10 (SEQ ID No. 427); 51H5 (SEQ ID No. 429); 51X5 (SEQ ID No. 1886); 52B1 (SEQ ID No. 430); 52C4 (SEQ ID No. 431); and 52D4 (SEQ ID No. 432). The trispecific proteins were purified into conditioned medium from pools of stable clones using protein A and ion exchange chromatography. An SDS-PAGE image of the purified proteins is provided in FIG. 17.

The affinity measurements for human and cynomolgus DLL3 were made using 60 nM, 20 nM, 6.67 nM, and 2.22 nM concentrations of biotinylated DLL3 targeting trispecific proteins immobilized on Octet streptavidin tips. The affinities determined from the measurements are listed in Table 10. In this experiment, anti-DLL3 trispecific containing DH6, the parental DLL3 binder sequence to the affinity matured DLL3 binder sequences, had $K_D$ values of 13.5 nM for human DLL3 and 11 nM for cynomolgus DLL3. In comparison, the ten anti-DLL3 trispecific proteins containing the affinity matured DLL3 binder molecules tested in this experiment had $K_D$ values ranging from 0.9 to 2.2 nM for human DLL3 and 1.4 to 3.4 nM for cynomolgus DLL3. Thus, the improvements in affinity range from 6.1 to 15 fold for human DLL3 and from 3.2 to 7.9 fold for cynomolgus DLL3.

Figure 18:
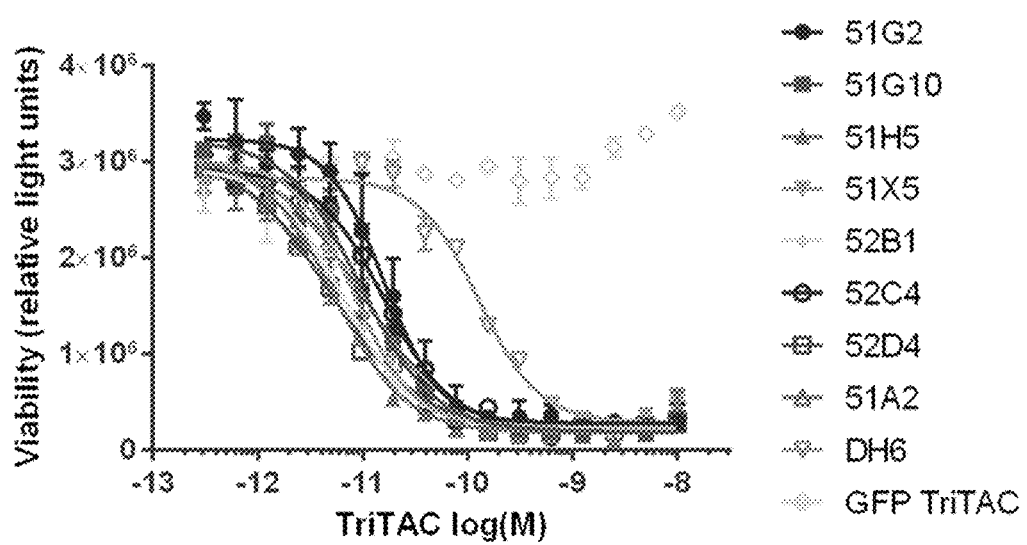
FIG. 18 illustrates results of a TDCC assay on DMS-53 cells, using exemplary purified affinity matured CHO expressed DLL3 targeting trispecific proteins containing exemplary DLL3 binding domains of this disclosure 51G2, 51G10, 51H5, 51X5, 52B1, 52C4, 52D4, 51A2, and parental DLL3 binder domain DH6, and a control trispecific protein.
Figure 19:
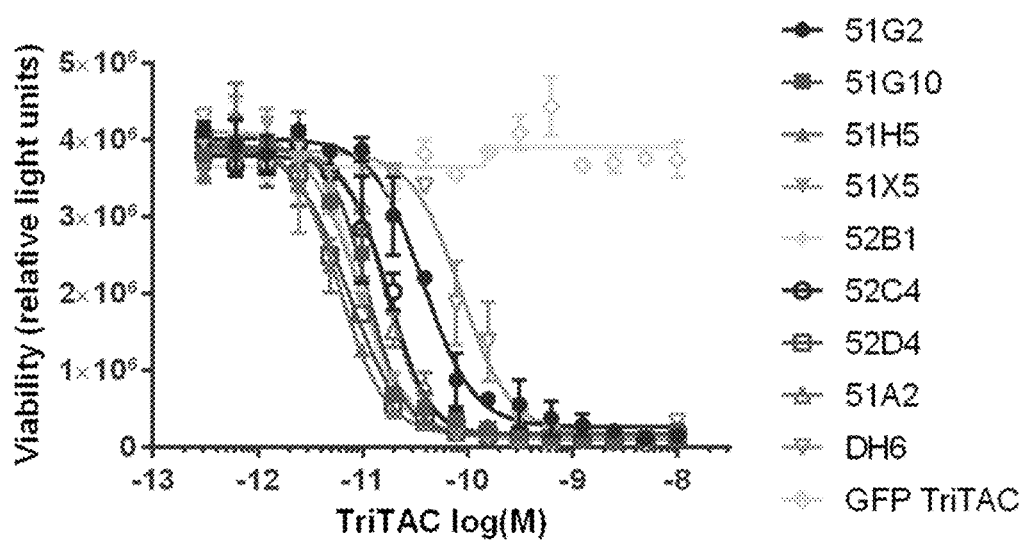
FIG. 19 illustrates results of a TDCC assay on DMS-153 cells, using exemplary purified affinity matured CHO expressed DLL3 targeting trispecific proteins of this disclosure, containing exemplary DLL3 binding domains of this disclosure 51G2, 51G10, 51H5, 51X5, 52B1, 52C4, 52D4, 51A2, and parental DLL3 binder domain DH6, and a control binding trispecific protein that targets GFP.

The purified proteins were tested in TDCC assays, using the same method as described in Example 2 except that two additional DLL3 expressing cell lines were included in the assay, DMS-53 and NCI-H510A. The $EC_{50}$ values from these TDCC assays are listed in Table 11, and the graphs of the DMS-53 and DMS-153 TDCC data are provided, respectively, in FIGS. 18-19. A trispecific molecule targeting GFP had no activity in these assays (as shown in FIGS. 18-19). Compared to the parental molecule DH6, the $EC_{50}$ values improved 2.3 to 12.1 fold in DMS-153 cells, 4.5 to 31.5 fold in NCI-H510A cells, and 8.1 to 26.1 fold in DMS-153 cells.

TABLE 10

Affinities of purified CHO expressed affinity matured anti-DLL3 trispecific proteins for human and cynomolgus DLL3 protein in vitro

| Name | huDLL3 $K_D$ (nM) | cyDLL3 $K_D$ (nM) |
|---|---|---|
| DH6 | 13.5 | 11.0 |
| 51A2 | 1.2 | 2.0 |
| 51A5 | 1.2 | 1.6 |
| 51F3 | 1.4 | 2.0 |
| 51G2 | 2.0 | 3.4 |
| 51G10 | 0.9 | 1.4 |
| 51H5 | 0.9 | 1.6 |
| 51X5 | 1.0 | 1.5 |
| 52B1 | 1.1 | 1.9 |
| 52C4 | 2.2 | 3.0 |
| 52D4 | 0.9 | 1.7 |

TABLE 11

TDCC Activity of purified CHO expressed affinity matured anti-DLL3 trispecific proteins with DMS153, NCI-H510A, and DMS53 cell lines and human T cells

| Name | DMS153 $EC_{50}$ (pM) | NCI-H510A $EC_{50}$ (pM) | DMS53 $EC_{50}$ (pM) |
|---|---|---|---|
| 51A2 | 16.7 | 9.1 | 9.8 |
| 51G2 | 37.7 | 3.7 | 15.9 |
| 51G10 | 11.0 | 2.3 | 9.6 |
| 51H5 | 6.0 | 2.4 | 5.4 |
| 51X5 | 9.0 | 2.8 | 8.3 |
| 52B1 | 9.1 | 1.3 | 6.5 |
| 52C4 | 17.9 | 2.0 | 15.9 |
| 52D4 | 7.2 | 2.5 | 4.9 |

Figure 20:
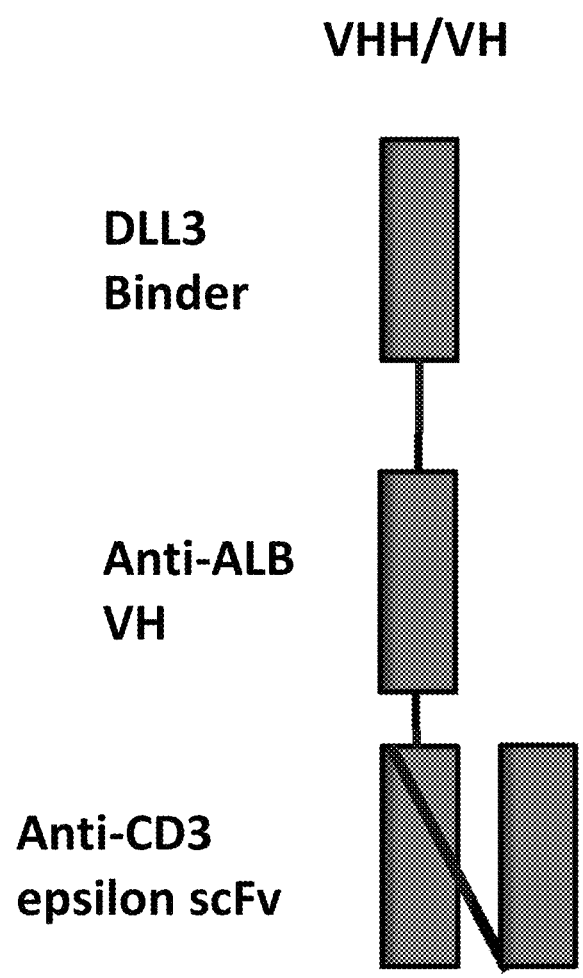
FIG. 20 provides a schematic illustration of a DLL3 targeting trispecific protein containing an exemplary DLL3 binding protein of this disclosure (DLL3 binder), a CD3 binding domain (anti-CD3 epsilon scFv), and an albumin binding (anti-ALB) domain, in an anti-DLL3:anti-ALB:anti-CD3 orientation (TAC orientation).
Figure 21:
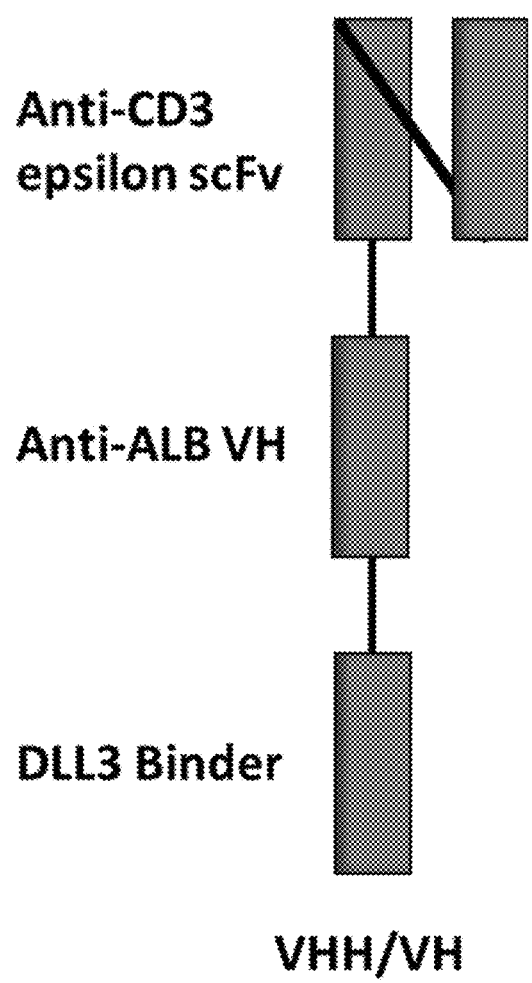
FIG. 21 provides a schematic illustration of a DLL3 targeting trispecific protein containing an exemplary DLL3 binding protein of this disclosure (DLL3 binder), a CD3 binding domain (anti-CD3 epsilon scFv), and an albumin binding (anti-ALB) domain, in an anti-CD3:anti-ALB:anti-DLL3 orientation (CAT orientation).
Figure 22:
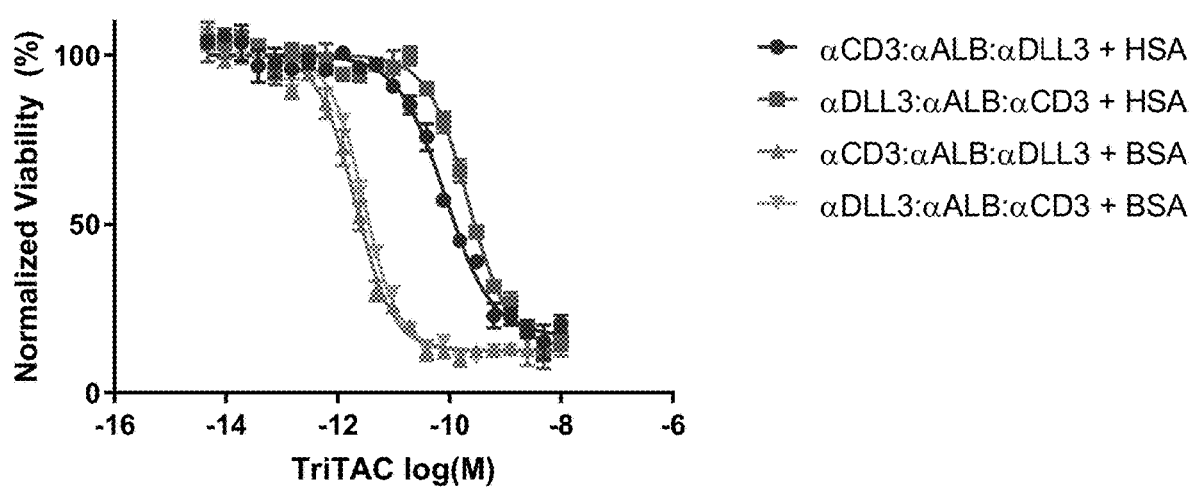
FIG. 22 illustrates results of a T cell dependent cellular cytotoxicity (TDCC) assay on NCI-H2171 cells, using exemplary DLL3 trispecific proteins containing a DLL3 binding domain of this disclosure, 52D04, in an anti-CD3:anti-ALB:anti-DLL3 (CAT) configuration or in an anti-DLL3:anti-ALB:anti-CD3 (TAC) configuration, tested in the presence of human serum albumin (HSA) or bovine serum albumin (BSA).
Figure 23:
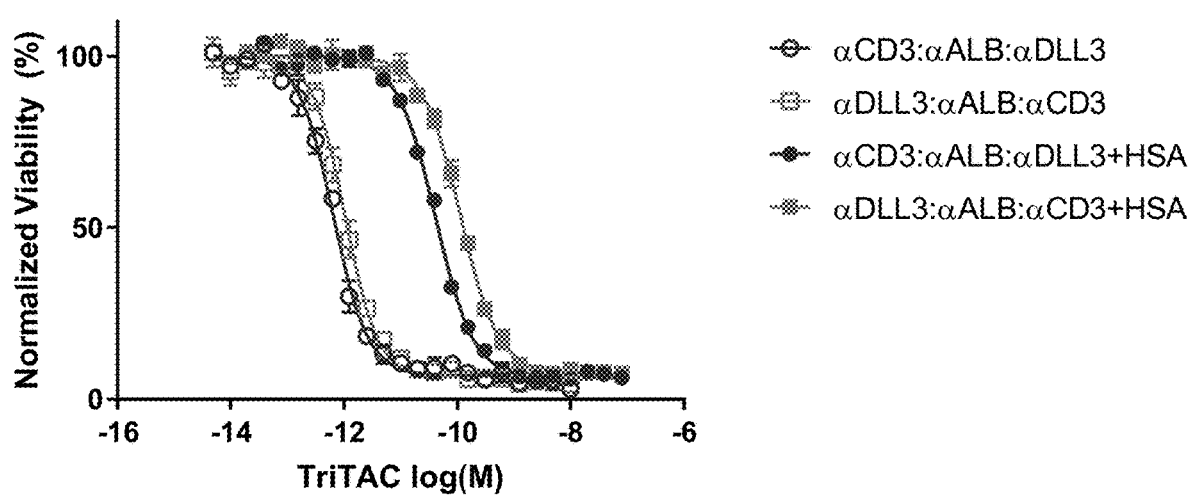
FIG. 23 illustrates results of a T cell dependent cellular cytotoxicity (TDCC) assay on DMS-79 cells, using exemplary DLL3 targeting trispecific proteins containing a DLL3 binding domain of this disclosure, 52D04, in an anti-CD3:anti-ALB:anti-DLL3 (CAT) configuration or in an anti-DLL3:anti-ALB:anti-CD3 (TAC) configuration, tested in the presence or absence of human serum albumin (HSA).
Figure 24:
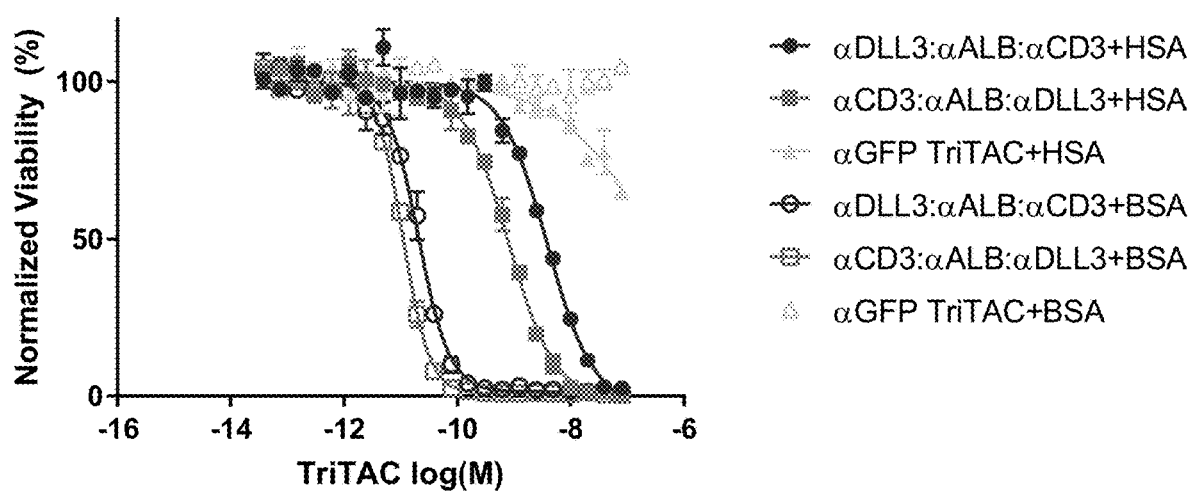
FIG. 24 illustrates results of a T cell dependent cellular cytotoxicity (TDCC) assay on SHP77 cells, using exemplary DLL3 trispecific proteins containing a DLL3 binding domain of this disclosure, 52D04, in an anti-CD3:anti-ALB:anti-DLL3 (CAT) configuration or in an anti-DLL3:anti-ALB:anti-CD3 (TAC) configuration, tested in the presence of human serum albumin (HSA) or bovine serum albumin (BSA).
Figure 25:
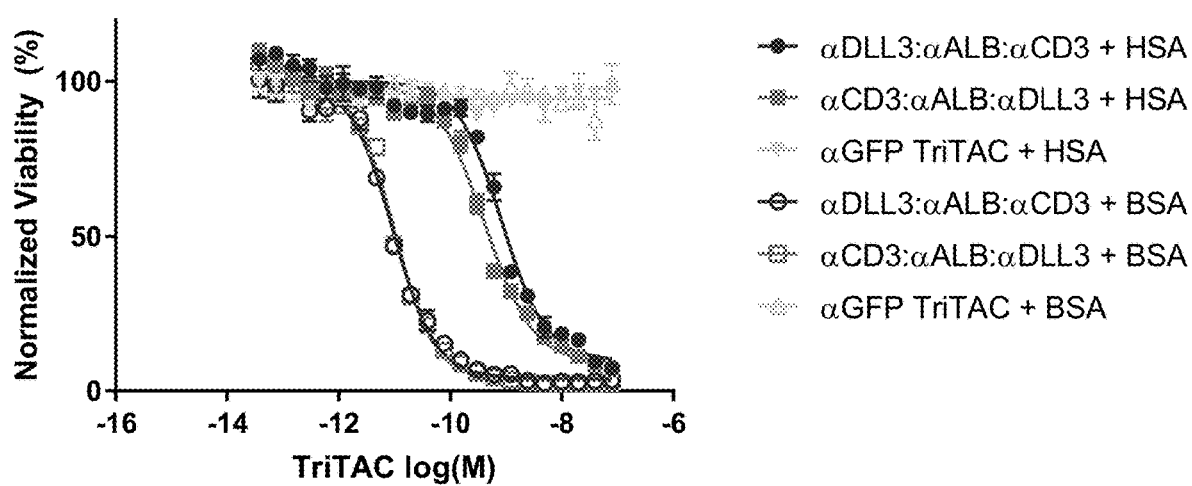
FIG. 25 illustrates results of a T cell dependent cellular cytotoxicity (TDCC) assay on WM2664 cells, using exemplary DLL3 trispecific proteins containing a DLL3 binding domain of this disclosure, 52D04, in an anti-CD3:anti-ALB:anti-DLL3 (CAT) configuration or in an anti-DLL3:anti-ALB:anti-CD3 (TAC) configuration, tested in the presence of human serum albumin (HSA) or bovine serum albumin (BSA).

Example 7: T Cell Dependent Cellular Cytotoxicity Assay Using Exemplary DLL3 Targeting Trispecific Proteins Comprising a DLL3 Binding Protein of this Disclosure Several exemplary DLL3 trispecific proteins containing a DLL3 binding domain of this disclosure, 52D04 (SEQ ID NO. 432), were tested in a T cell dependent cellular cytotoxicity (TDCC) assay (see Nazarian A A, Archibeque I L, Nguyen Y H, Wang P, Sinclair A M, Powers D A. 2015. J Biomol Screen. 20:519-27), the results are shown in FIGS. 22-24. The trispecific proteins contained a DLL3 binding domain, an albumin binding domain (anti-ALB), and a CD3 binding domain (anti-CD3), in an anti-DLL3:anti-ALB:anti-CD3 configuration (TAC), as shown in FIG. 20, or in an anti-CD3:anti-ALB:anti-DLL3 (CAT) configuration, as shown in FIG. 21. The TDCC assay was carried out in the presence or absence of 15 mg/ml human serum albumin (HSA). In this assay, luciferase labelled NCI-H2171 (FIG. 22), DMS-79 (FIG. 23), SHP77 (FIG. 24), or WM2664 (FIG. 25) cells were combined with purified human T cells and a titration of the exemplary DLL3 binding trispecific proteins, in the presence or absence of albumin. It was hypothesized that if an DLL3 binding trispecific protein directed T cells to kill the DLL3-expression NCI-H2171, DMS-79, SHP77, or WM2664 cells, then the viability of those cells, as determined by running a luciferase assay at 48 hours after starting the experiment, should decrease. FIG. 22 illustrates a graph of representative TDCC data, using NCI-H2171 cells, for the DLL3 binding trispecific proteins in the TAC or CAT configurations, containing the following DLL3 binding domains. FIG. 23 illustrates a graph of representative TDCC data, using DMS-79 cells, for the DLL3 binding trispecific proteins in the TAC or CAT configurations, containing the following DLL3 binding domains. FIG. 24 illustrates a graph of representative TDCC data, using SHP77 cells, for the DLL3 binding trispecific proteins in the TAC or CAT configurations, containing the following DLL3 binding domains. FIG. 25 illustrates a graph of representative TDCC data, using WM2664 cells, for the DLL3 binding trispecific proteins in the TAC or CAT configurations, containing the following DLL3 binding domains. $EC_{50}$ values from the TDCC assay are listed in Table 12. As shown in the graphs and indicated by the $EC_{50}$ values, in the presence of human serum albumin (HSA) the DLL3 binding trispecific proteins having the CAT orientation (FIG. 21) were more potent in the TDCC assays than the DLL3 binding trispecific proteins having the TAC configuration.

TABLE 12

TDCC Activity of exemplary anti-DLL3 trispecific proteins with
NCI-H2171, DMS-79, SHP77, and cell lines and human T cells

| Cell Line | | $EC_{50}$ (pM) no HSA | $EC_{50}$ (pM) with HSA |
|---|---|---|---|
| NCI-H2171 | αDLL3:αALB:αCD3 | 3 | 224 |
|  | αCD3:αALB:αDLL3 | 2 | 84 |
| DMS-79 | αDLL3:αALB:αCD3 | 1.1 | 115 |
|  | αCD3:αALB:αDLL3 | 0.7 | 41 |
| SHP77 | αDLL3:αALB:αCD3 | 21* | 3953 |
|  | αCD3:αALB:αDLL3 | 11* | 821 |
| WM2664 | αDLL3:αALB:αCD3 | 9* | 855 |
|  | αCD3:αALB:αDLL3 | 10* | 422 |

*15 mg/ml bovine serum albumin (BSA) was included in these no HSA assays; the αALB domain did not bind BSA (data not shown)

Figure 26:
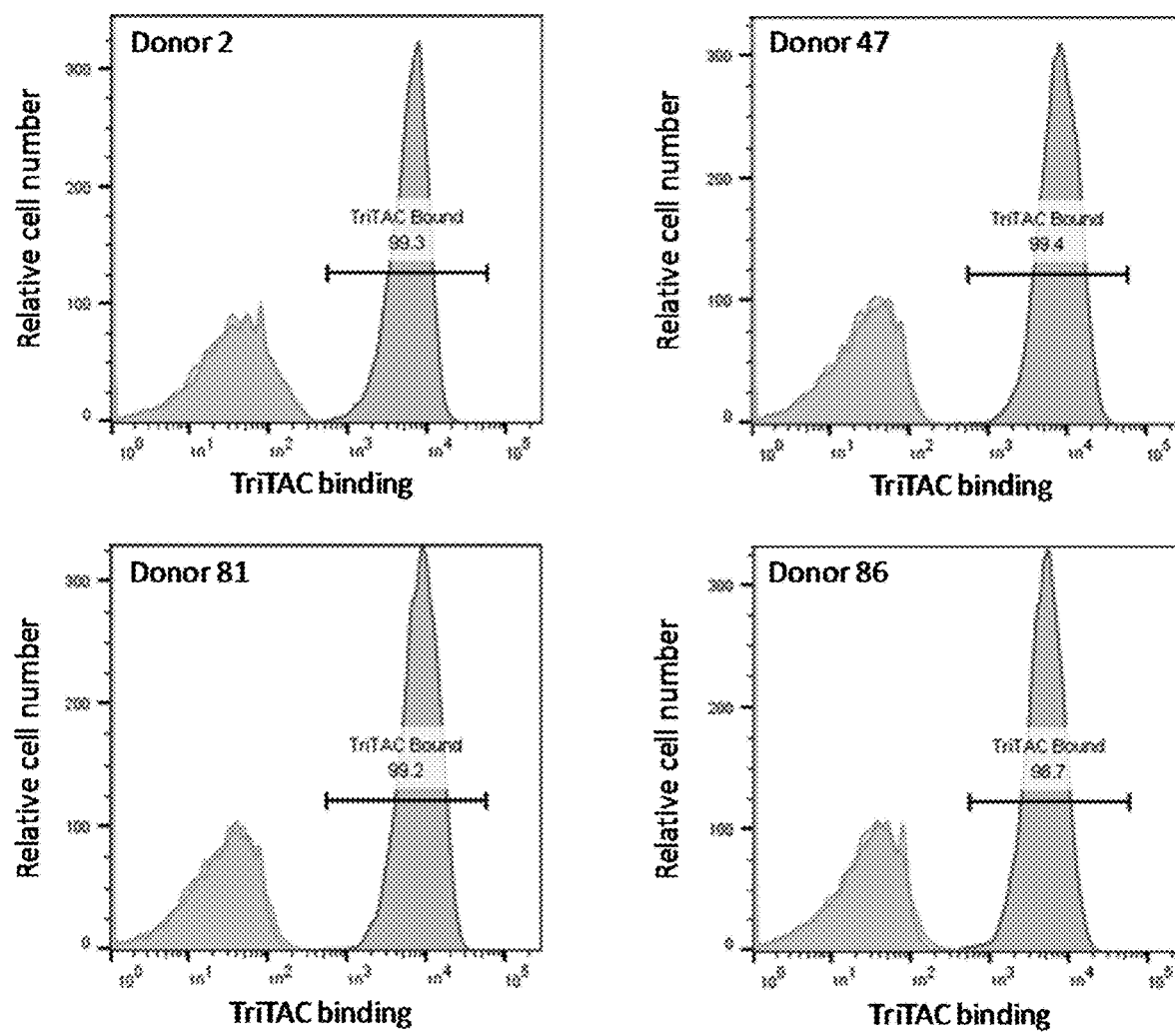
FIG. 26 depicts binding of an exemplary DLL3 targeting trispecific proteins containing DLL3 binding domain of this disclosure, 52D04, in an anti-DLL3:anti-ALB:anti-CD3 (TAC) configuration to human T cells from four different donors as compared to that of a controls with secondary antibody alone or cells without any antibody or trispecific molecule.
Figure 27:
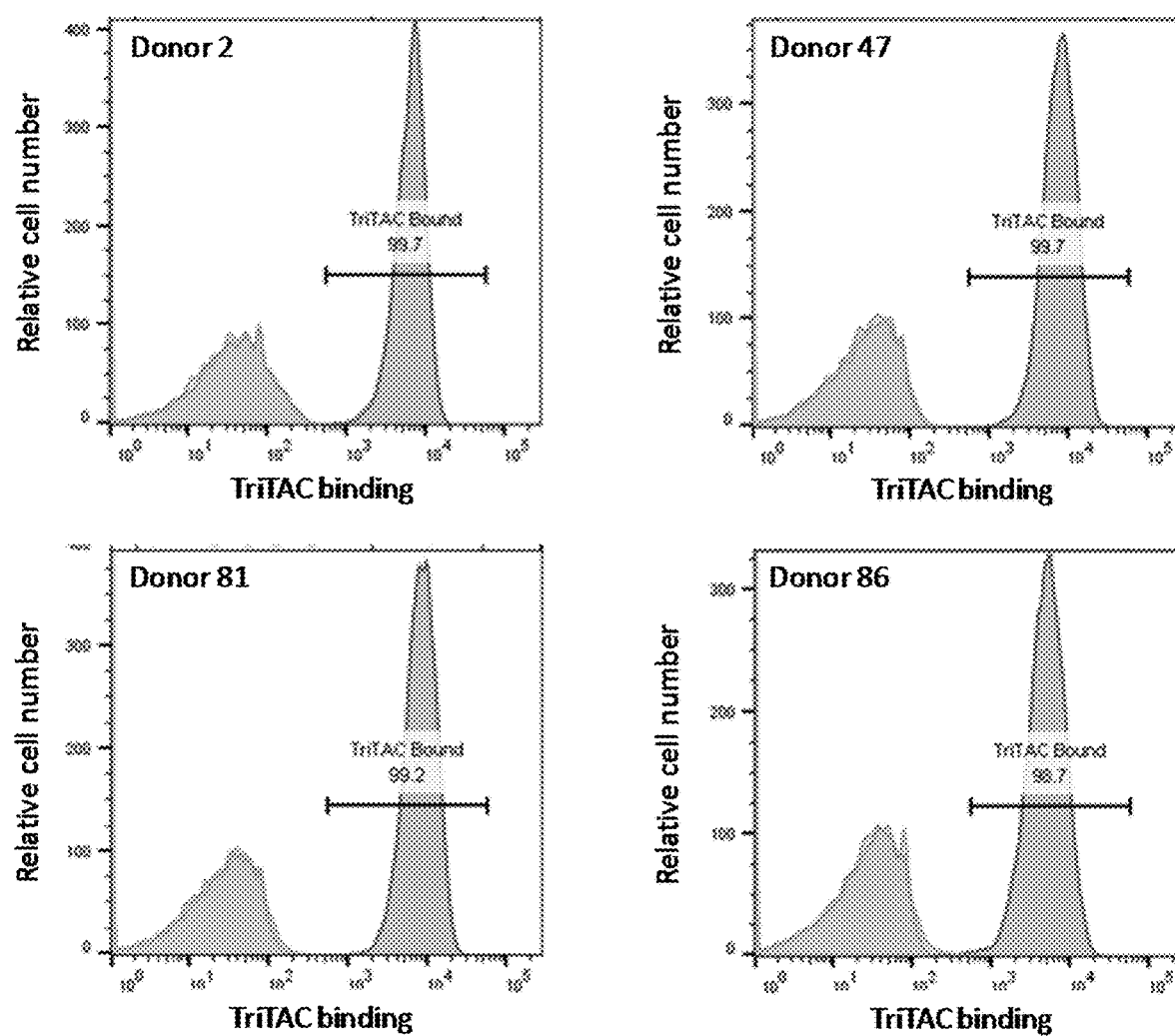
FIG. 27 depicts binding of an exemplary DLL3 targeting trispecific proteins containing DLL3 binding domain of this disclosure, 52D04, in an anti-CD3:anti-ALB:anti-DLL3 (CAT) configuration to human T cells from four different donors as compared to that of a controls with secondary antibody alone or cells without any antibody or trispecific molecule.

Example 8: Binding of Exemplary DLL3 Targeting Trispecific Proteins to Human T Cells In a cell binding study, human T cells were incubated in the presence or absence of an exemplary DLL3 targeting trispecific protein (in either anti-DLL3:anti-ALB:anti-CD3 (TAC) configuration (SEQ ID No. 1891; or anti-CD3:anti-ALB:anti-DLL3 (CAT) configuration (SEQ ID No. 1890). The human T cells were further incubated with a secondary antibody (anti-trispecific antibody), which is able to recognize the anti-albumin domain in the exemplary trispecific molecules, conjugated to Alexa Fluor 647. Binding of the anti-trispecific antibody was measured by flow cytometry. Robust binding of anti-trispecific antibody was seen in the presence of the exemplary DLL3 trispecific protein in the anti-DLL3:anti-ALB:anti-CD3 (TAC) configuration (right peaks in the plots in FIG. 26) compared to cells incubated with secondary antibody alone or cells incubated without exemplary trispecific proteins or secondary antibody (left peaks in the plots in FIG. 26). Robust binding of anti-trispecific antibody was also seen in the presence of the exemplary DLL3 trispecific protein in the anti-CD3:anti-ALB:anti-DLL3 (CAT) configuration (right peaks in the plots in FIG. 27) compared to cells incubated with secondary antibody alone or cells incubated without exemplary trispecific proteins or secondary antibody (left peaks in the plots in FIG. 27).

Figure 28:
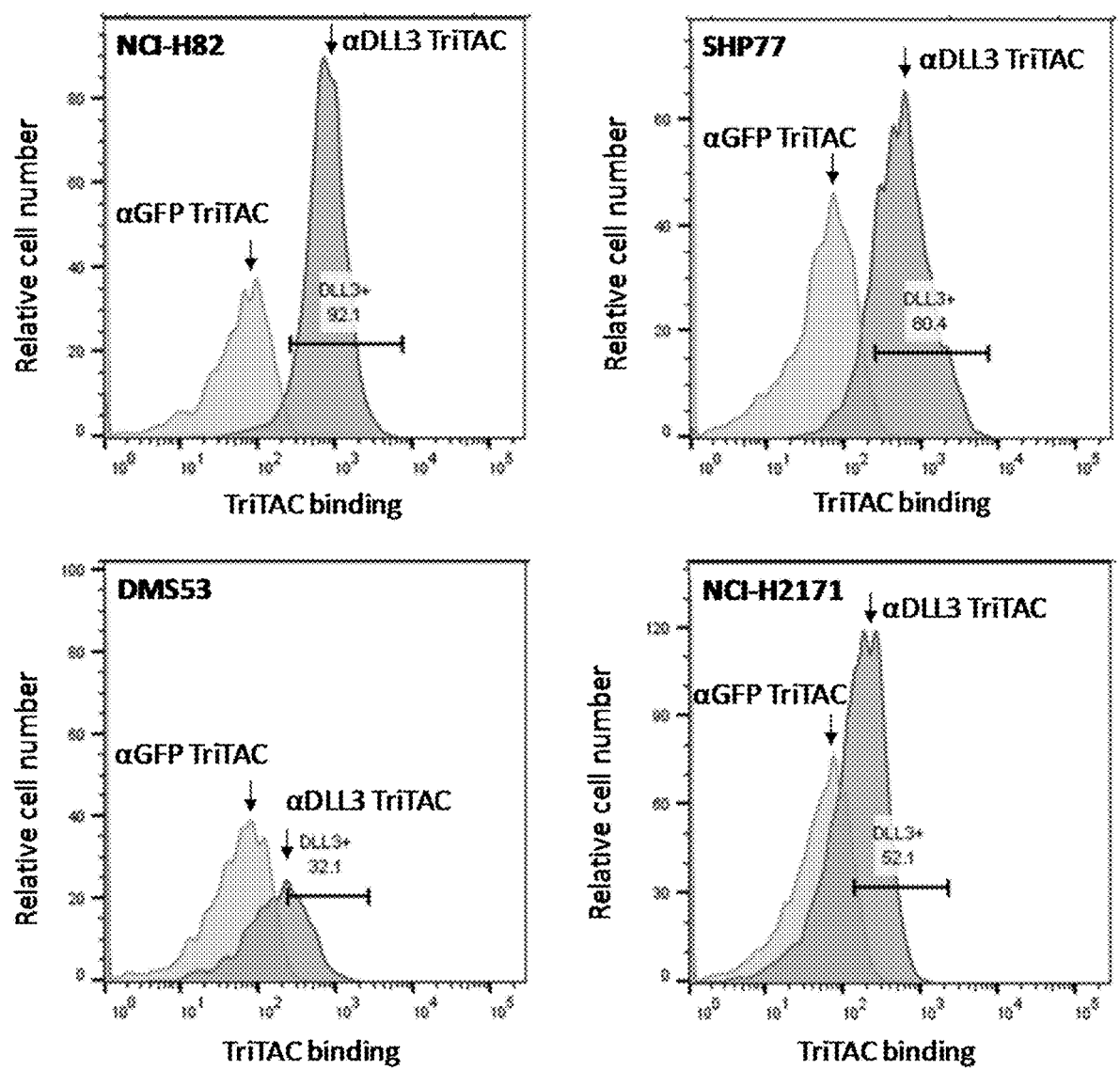
FIG. 28 depicts binding of an exemplary DLL3 targeting trispecific proteins containing DLL3 binding domain of this disclosure, 52D04, in an anti-DLL3:anti-ALB:anti-CD3 (TAC) configuration to human DLL3 expressing cell lines NCI-H82 (top left), SHP77 (top right), DMS53 (bottom left) or NCI-H2171 (bottom right) compared to a trispecific molecules with an GFP binding domain.
Figure 29:
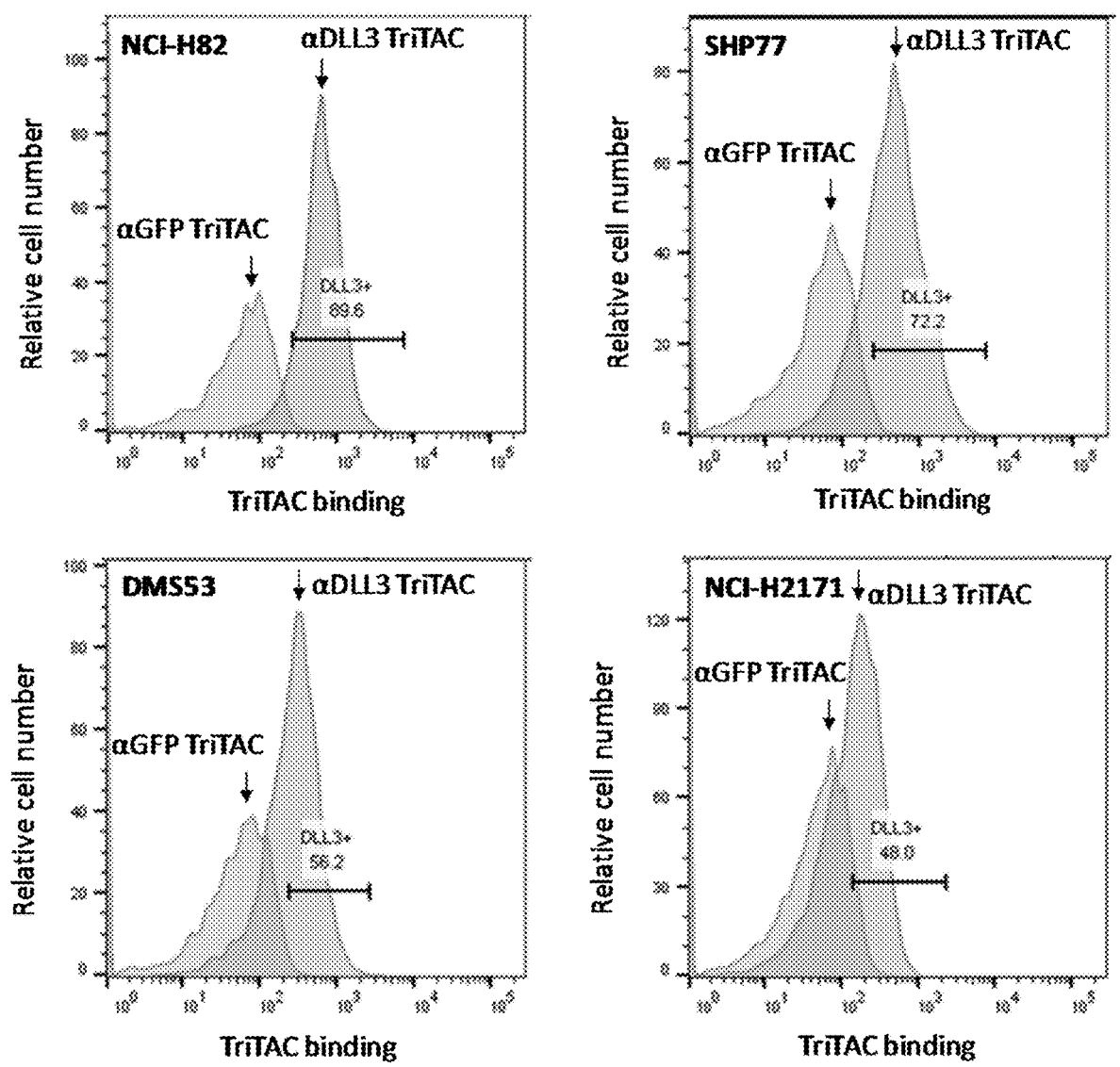
FIG. 29 depicts binding of an exemplary DLL3 targeting trispecific proteins containing DLL3 binding domain of this disclosure, 52D04, in an anti-CD3:anti-ALB:anti-DLL3 (CAT) configuration to human DLL3 expressing cell lines NCI-H82 (top left), SHP77 (top right), DMS53 (bottom left) or NCI-H2171 (bottom right) compared to a trispecific molecules with an GFP binding domain.
Figure 30:
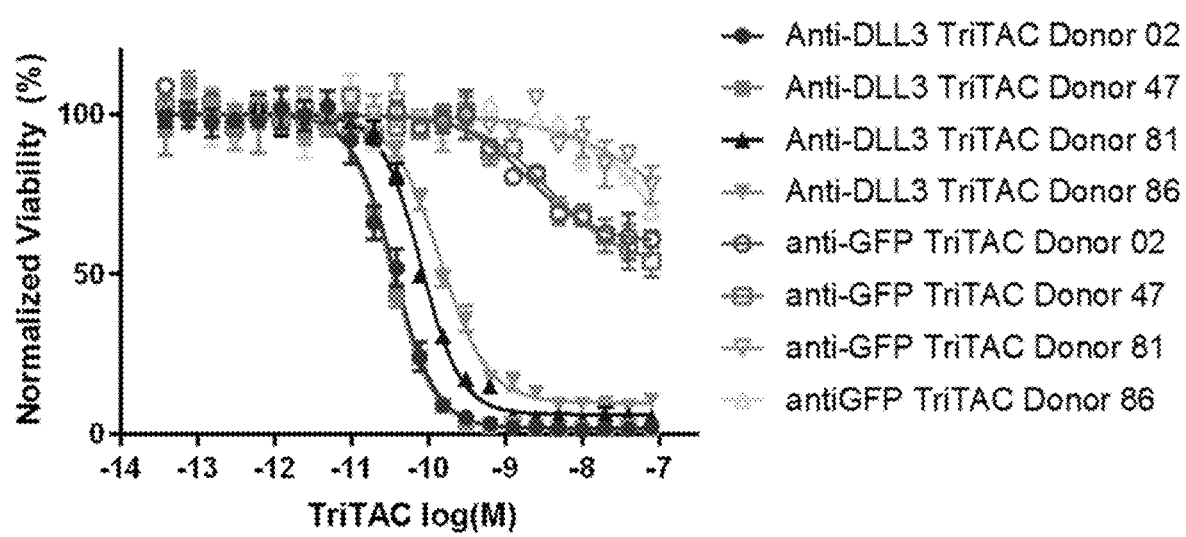
FIG. 30 illustrates the results of a TDCC assay on NCI-H82 cells, using exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA), using T cells from four different donors.
Figure 31:
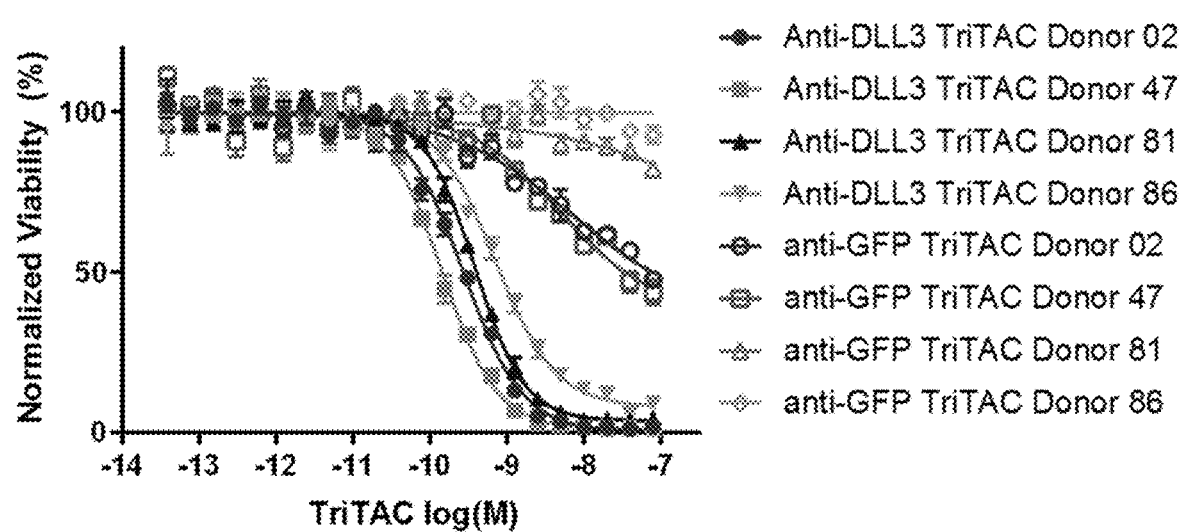
FIG. 31 illustrates the results of a TDCC assay on SHP77 cells, using exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA), using T cells from four different donors.
Figure 32:
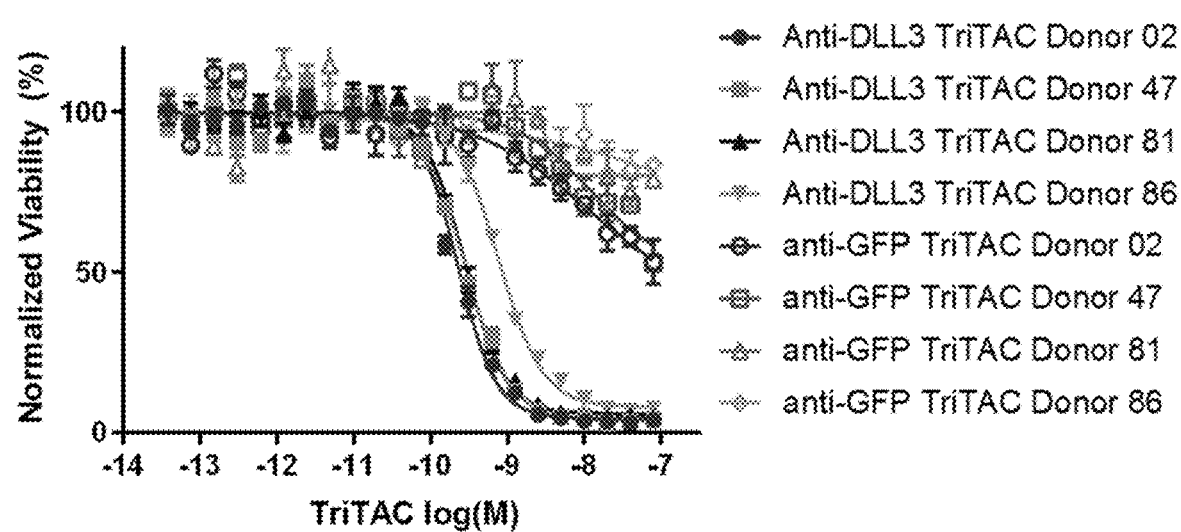
FIG. 32 illustrates the results of a TDCC assay on DMS53 cells, using exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA), using T cells from four different donors.
Figure 33:
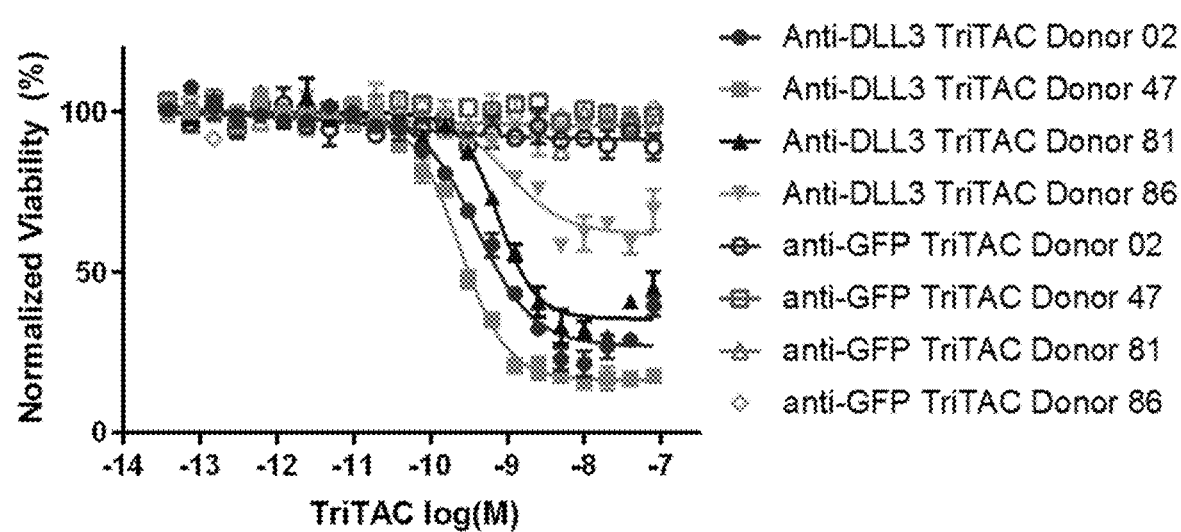
FIG. 33 illustrates the results of a TDCC assay on NCI-H2171 cells, using exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA), using T cells from four different donors.
Figure 34:
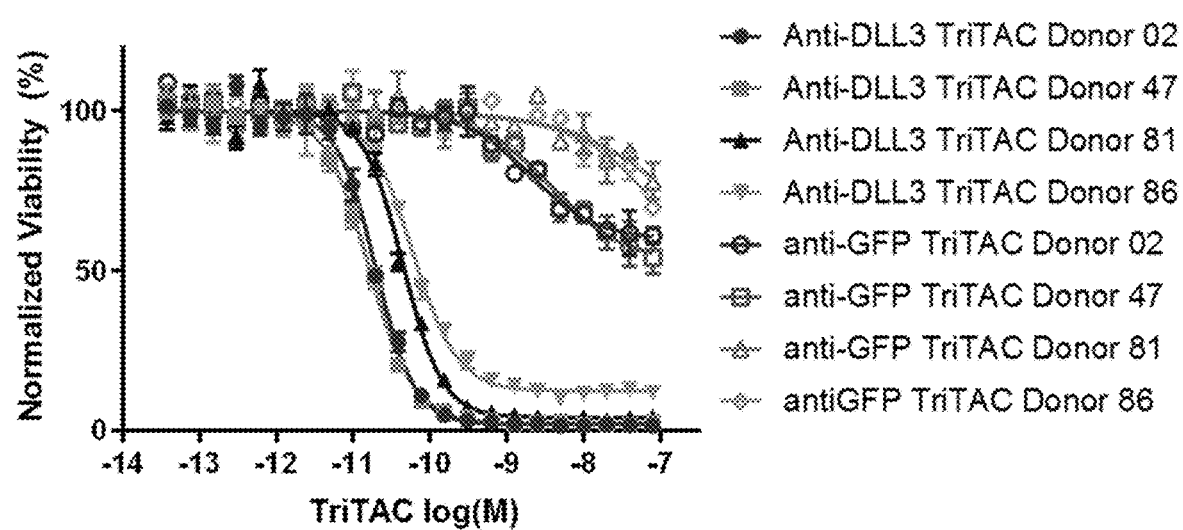
FIG. 34 illustrates the results of a TDCC assay on NCI-H82 cells, using exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA), using T cells from four different donors.
Figure 35:
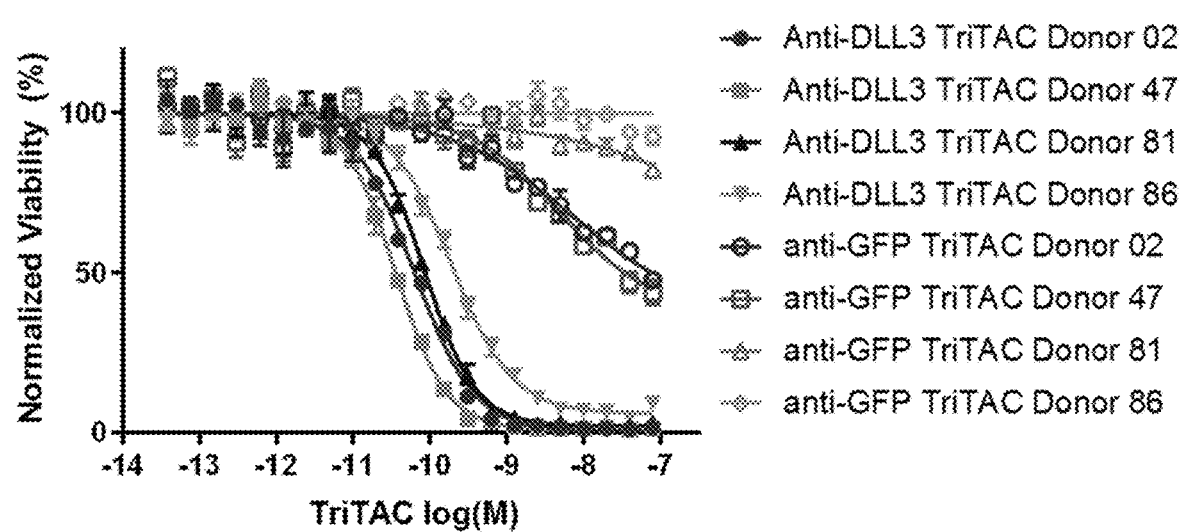
FIG. 35 illustrates the results of a TDCC assay on SHP77 cells, using exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA), using T cells from four different donors.
Figure 36:
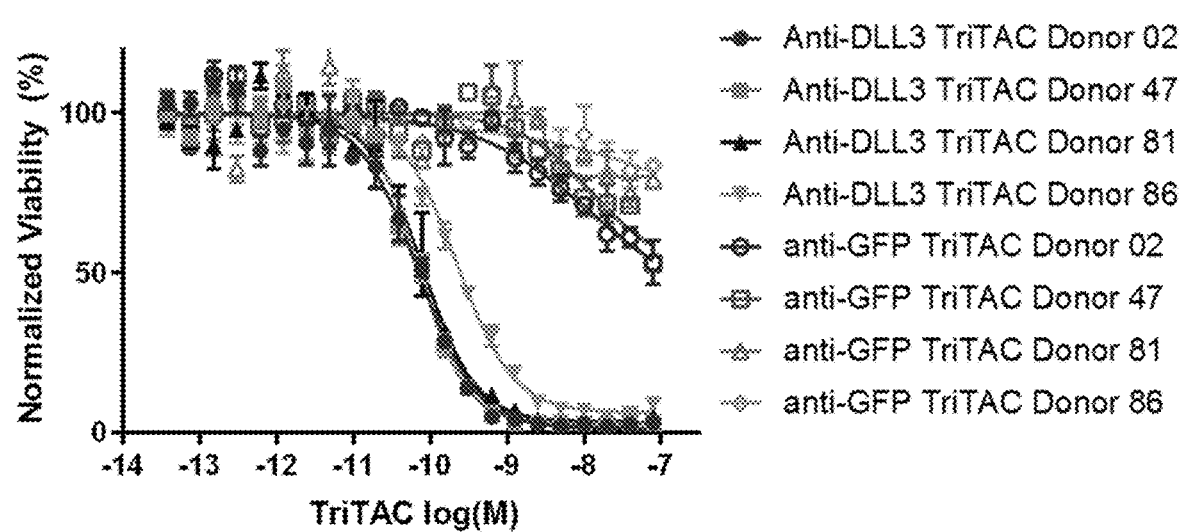
FIG. 36 illustrates the results of a TDCC assay on DMS53 cells, using exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA), using T cells from four different donors.
Figure 37:
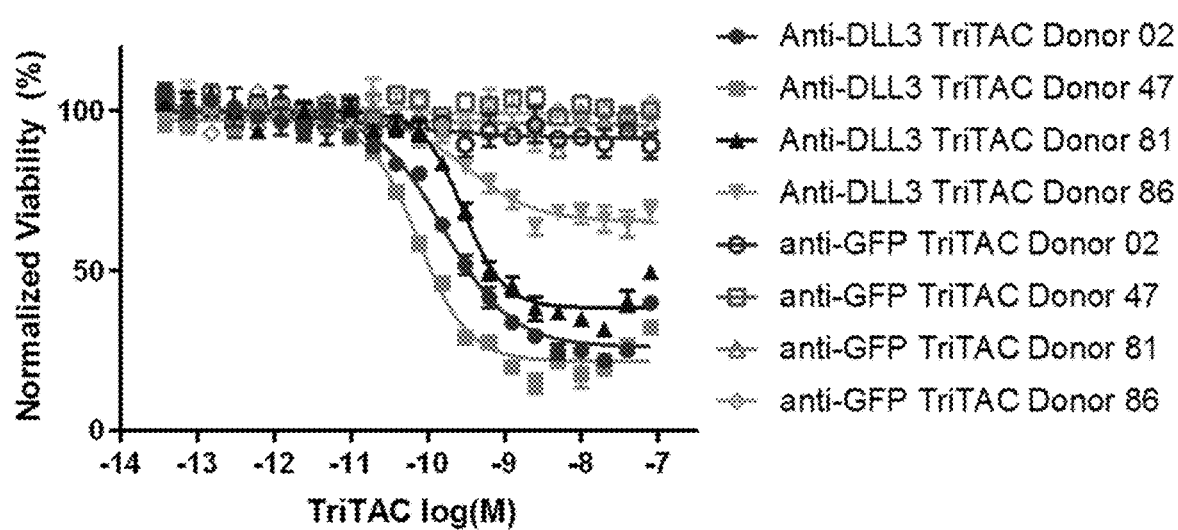
FIG. 37 illustrates the results of a TDCC assay on NCI-H2171 cells, using exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA), using T cells from four different donors.
Figure 38:
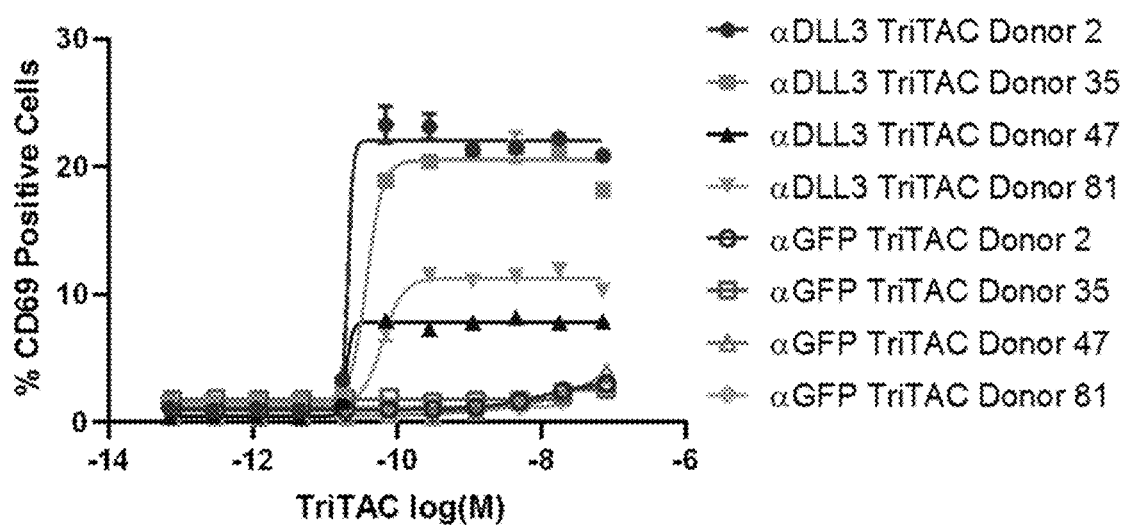
FIG. 38 illustrates the results of a flow cytometry measurements of CD69 expression on T cells co-cultured with NCI-H82 cells with a titration of an exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA), using T cells from four different donors.
Figure 39:
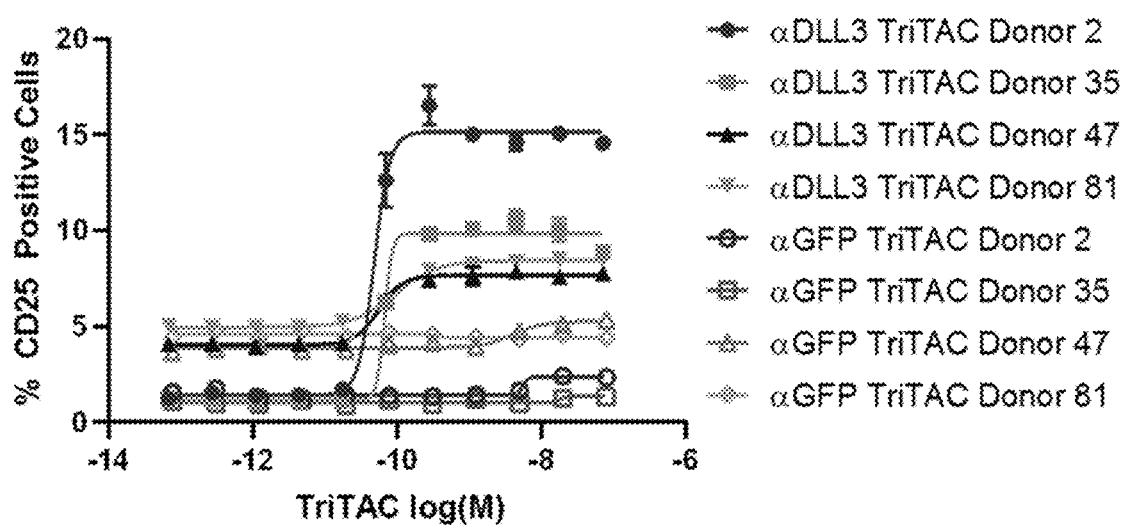
FIG. 39 illustrates the results of a flow cytometry measurements of CD25 expression on T cells co-cultured with NCI-H82 cells with a titration of an exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA), using T cells from four different donors.
Figure 40:
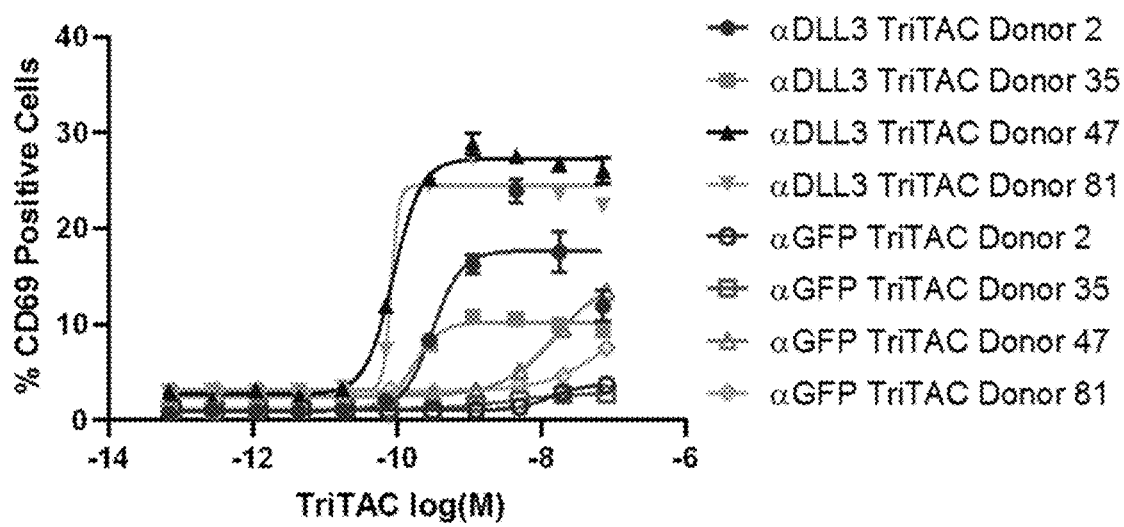
FIG. 40 illustrates the results of a flow cytometry measurements of CD69 expression on T cells co-cultured with DMS53 cells with a titration of an exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA, using T cells from four different donors.
Figure 41:
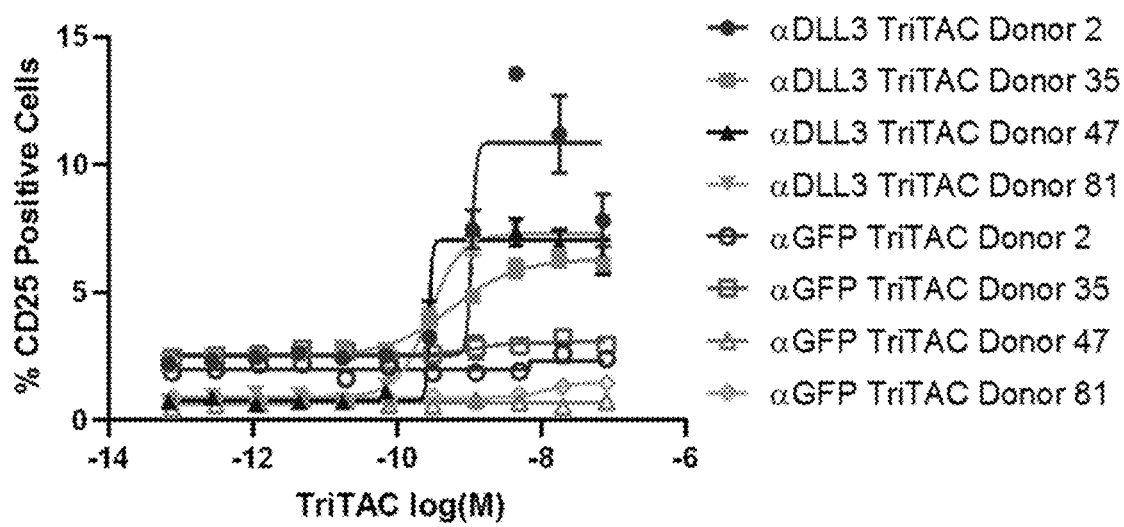
FIG. 41 illustrates the results of a flow cytometry measurements of CD25 expression on T cells co-cultured with DMS53 cells with a titration of an exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA).
Figure 42:
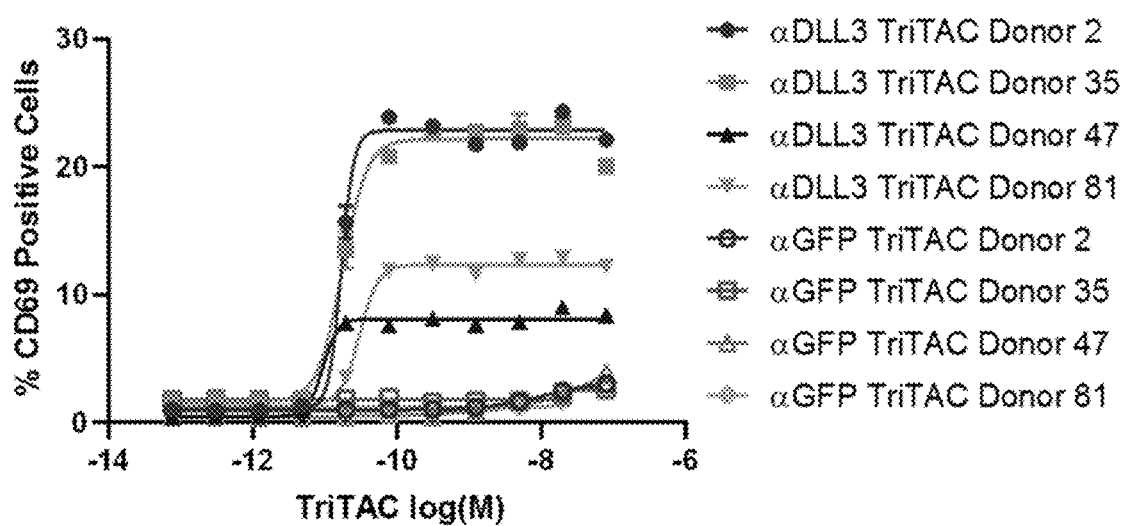
FIG. 42 illustrates the results of a flow cytometry measurements of CD69 expression on T cells co-cultured with NCI-H82 cells with a titration of an exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA), using T cells from four different donors.
Figure 43:
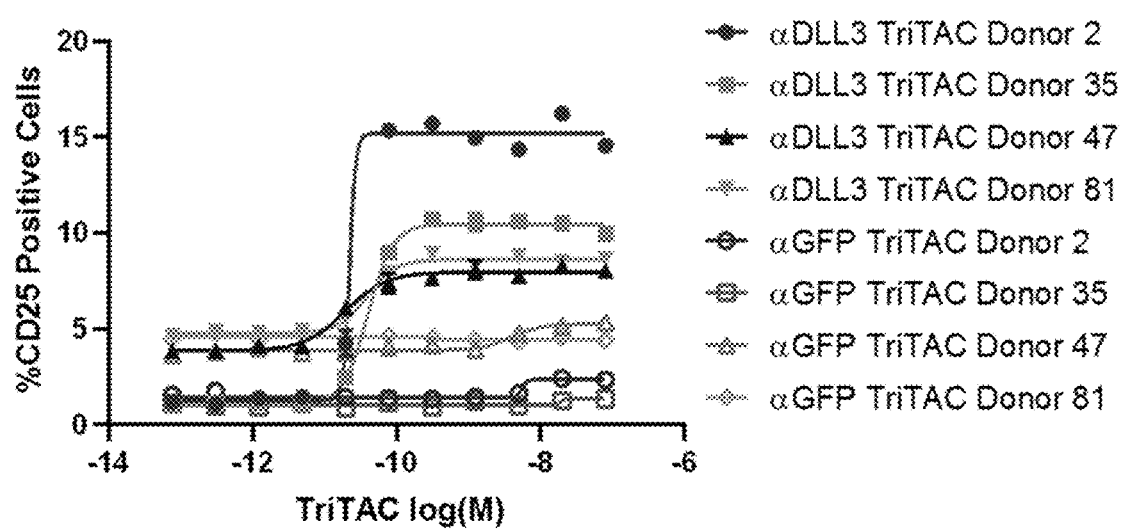
FIG. 43 illustrates the results of a flow cytometry measurements of CD25 expression on T cells co-cultured with NCI-H82 cells with a titration of an exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA), using T cells from four different donors.
Figure 44:
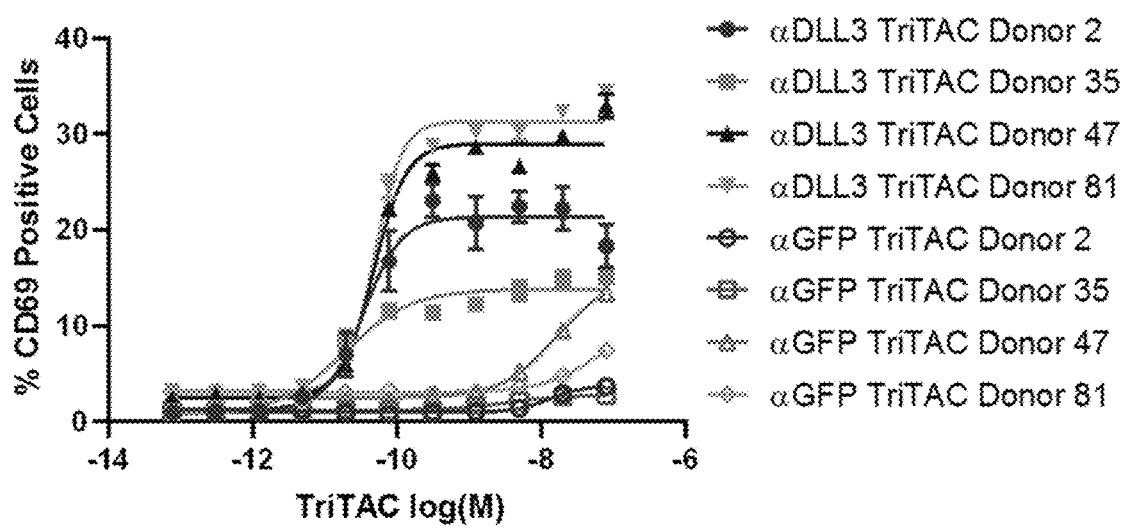
FIG. 44 illustrates the results of a flow cytometry measurements of CD69 expression on T cells co-cultured with DMS53 cells with a titration of an exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA), using T cells from four different donors.
Figure 45:
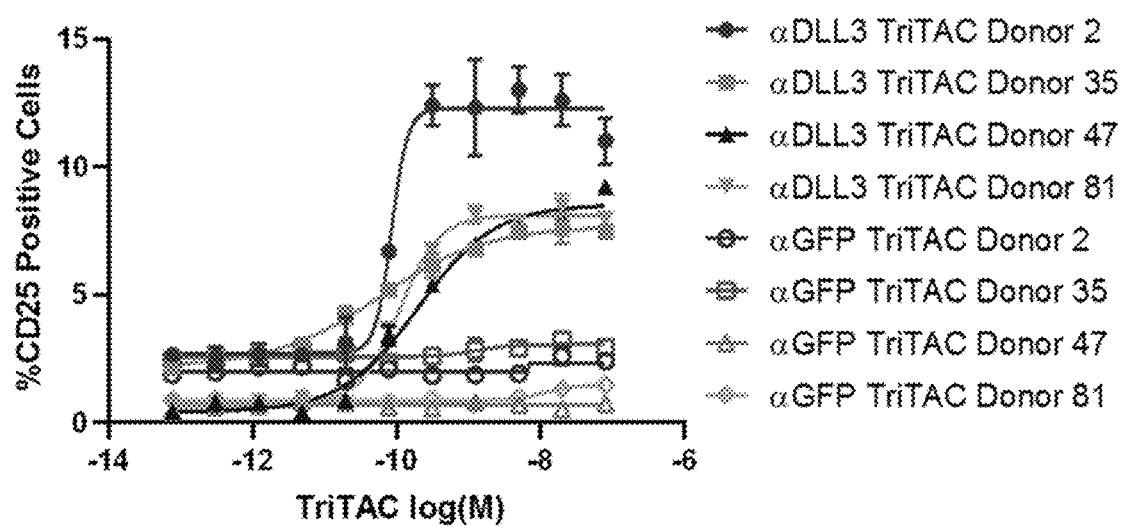
FIG. 45 illustrates the results of a flow cytometry measurements of CD25 expression on T cells co-cultured with DMS53 cells with a titration of an exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA).

Example 9: Binding of Exemplary DLL3 Targeting Trispecific Proteins to DLL3 Expressing Cancer Cell Lines In another binding study, DLL3 expressing cancer cells [NCI-H82 (lung cancer cell line), SHP77 (lung cancer cell line), DMS53 (lung carcinoma), or NCI-H2171 (lung cancer cell line)] were incubated with exemplary DLL3 targeting trispecific molecules (in CAT or TAC configuration; SEQ ID No. 1890 and SEQ ID No. 1891) or a control trispecific molecule that targets GFP. Following incubation, the cells were washed to remove unbound trispecific molecules and further incubated with a secondary antibody, which is able to recognize the anti-albumin domain in the trispecific molecules, conjugated to Alexa Fluor 647 or FITC. Binding of the exemplary DLL3 targeting trispecific molecules or that of the control trispecific molecules to the cells was measured by flow cytometry. Robust binding of DLL3 targeting trispecific (in TAC configuration) to each cell line was observed (right peaks in the plots in FIG. 28) compared to cells incubated with a control trispecific molecule targeting GFP (left peaks in the plots in FIG. 28). Robust binding of DLL3 targeting trispecific (in CAT configuration) to each cell line was also observed (right peaks in the plots in FIG. 29) compared to cells incubated with a control trispecific molecule targeting GFP (left peaks in the plots in FIG. 29). In control experiments with cell lines that lack DLL3 expression, HCTI16 (colon cancer cell line) and NCI-H292 (lung cancer cell line), similar amount of anti-trispecific antibody were bound to cells incubated with the exemplary DLL3 targeting trispecific proteins or GFP-targeting control trispecific molecules (data not shown), indicating the exemplary DLL3-targeting trispecific molecules did not bind to cells lacking DLL3 expression.

Example 10: Ability of Exemplary DLL3 Targeting Trispecific Proteins to Direct T Cell Mediated Killing of DLL3 Expressing Cancer Cell Lines The aim of this study was to assess if exemplary DLL3 targeting trispecific molecules were able to direct T cells to kill the DLL3-expressing cell lines NCI-H82, SHP77, DMS53, and NCI-H2171. The DLL3-expressing cells used in this study were engineered to express luciferase.

For the TDCC assay (T cell dependent cellular cytotoxicity assay) T cells from four healthy donors (donor 2; donor 47; donor 81; donor 86) and the DLL3-expressing cells were mixed and varying amounts of exemplary DLL3 targeting trispecific proteins (in CAT or TAC configurations; SEQ ID No. 1890 and SEQ ID No. 1891) was added to the mixture. The mixture was incubated for 48 hours at 37° C. As a control, parallel experiments were performed using a control trispecific molecule targeting GFP. After 48 hours, the remaining viable DLL3-expressing cells were quantified using a luminescence assay. It was observed that the DLL3-targeting trispecific molecules (in both TAC and CAT configurations) were able to efficiently direct T cells from all four healthy donors to kill all four DLL3 expressing cell lines (see FIGS. 30, 31, 32, and 33 for results using the TAC configuration; see FIGS. 34, 35, 36, and 37 for results using the CAT configuration) whereas the control GFP TriTAC molecule was not able to do that (also shown in FIGS. 30-37). The $EC_{50}$ values are presented in Table 13 and Table 14. Further TDCC assays were carried out with DLL3-targeting TriTAC and cell lines that lack DLL3 expression, NCI-H292 and HCT116. It was observed that the DLL3-targeting TriTAC was not able to direct T cells to kill these two cell lines lack DLL3 expression (data not shown).

TABLE 13

$EC_{50}$ values for TDCC assays performed using exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA), using T cells from four different donors.

| | $EC_{50}$ (M) | | | |
|---|---|---|---|---|
| Cell Line | Donor 02 | Donor 47 | Donor 81 | Donor 86 |
| NCI-H82 | 3.6E−11 | 3.3E−11 | 8.0E−11 | 1.4E−10 |
| SHP77 | 2.7E−10 | 1.4E−10 | 3.8E−10 | 7.0E−10 |
| DMS53 | 2.3E−10 | 2.8E−10 | 2.8E−10 | 7.7E−10 |
| NCI-2171 | 4.0E−10 | 2.4E−10 | 7.5E−10 | 1.0E−09 |

TABLE 14

EC$_{50}$ values for TDCC assays performed using exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA), using T cells from four different donors.

| Cell Line | EC$_{50}$ (M) | | | |
|---|---|---|---|---|
| | Donor 02 | Donor 47 | Donor 81 | Donor 86 |
| NCI-H82 | 2.0E−11 | 1.6E−11 | 4.5E−11 | 5.9E−11 |
| SHP77 | 6.3E−11 | 3.6E−11 | 8.4E−11 | 1.9E−10 |
| DMS53 | 7.0E−11 | 7.2E−11 | 8.0E−11 | 2.2E−10 |
| NCI-2171 | 1.6E−10 | 7.6E−11 | 2.9E−10 | 3.2E−10 |

Example 11: DLL3 Dependent Activation of T Cells by Exemplary DLL3 Targeting Trispecific Proteins In this assay, T cells from 4 different healthy donors (donor 2; donor 35; donor 47; and donor 86) and NCI-H82 or DMS53 cells were incubated with exemplary DLL3 targeting trispecific proteins (in CAT or TAC configurations; SEQ ID No. 1890 and SEQ ID No. 1891) for 48 hours at 37° C. T cells from the same donors were also incubated for 48 hours at 37° C. with a control trispecific molecule, GFP TriTAC, which targets GFP and NCI-H82 or DMS53 cells. After 48 hours, T cells were collected, and CD69 and CD25 expression on the T cells was measured by flow cytometry. Increased CD69 or CD25 expression was detected on T cells from all 4 healthy donors in presence of NCI-H82 or SHP77 cells and DLL3 targeting trispecific molecules but not in presence of the negative control GFP TriTAC, as seen in FIGS. 38-45. A parallel experiment was performed with HCT116 cells, which lack DLL3 expression. No increase CD69 or CD25 expression was observed with DLL3 trispecific molecules tested using HCT116 cells (data not shown).

Figure 46:
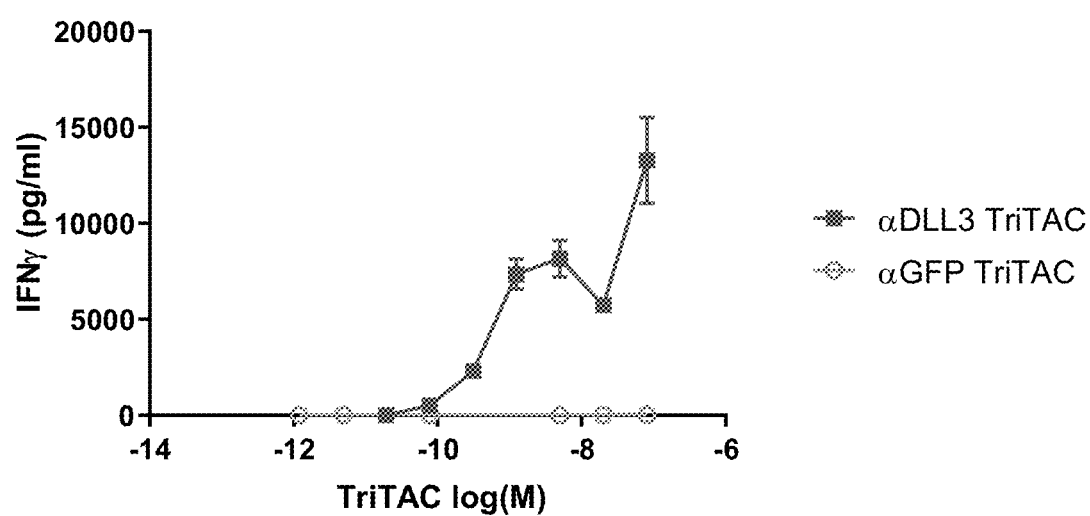
FIG. 46 illustrates the results of IFNγ measurements in conditioned media from co-cultures of T cells and NCI-H82 cells incubated with a titration of an exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA).
Figure 47:
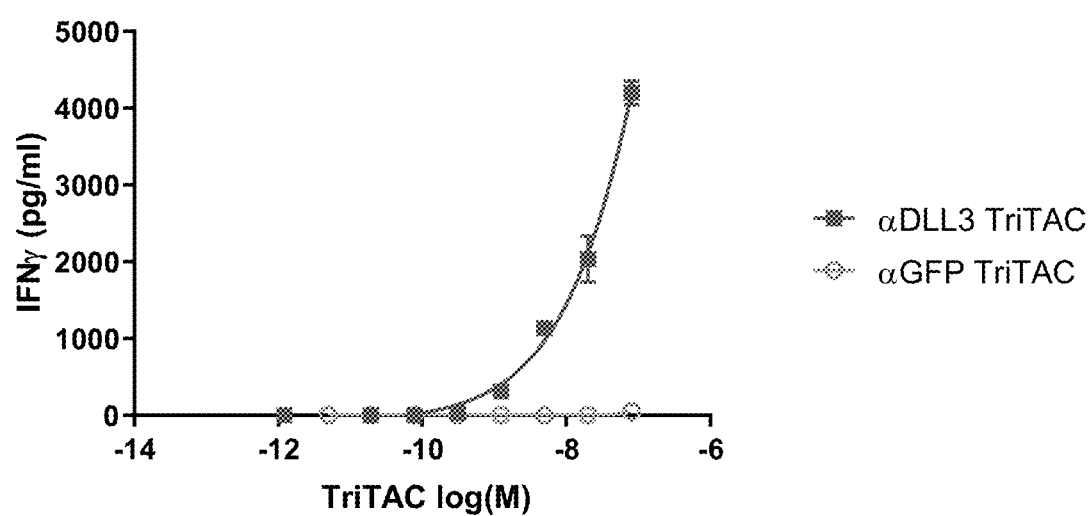
FIG. 47 illustrates the results of IFNγ measurements in conditioned media from co-cultures of T cells and SHP77 cells incubated with a titration of an exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA).
Figure 48:
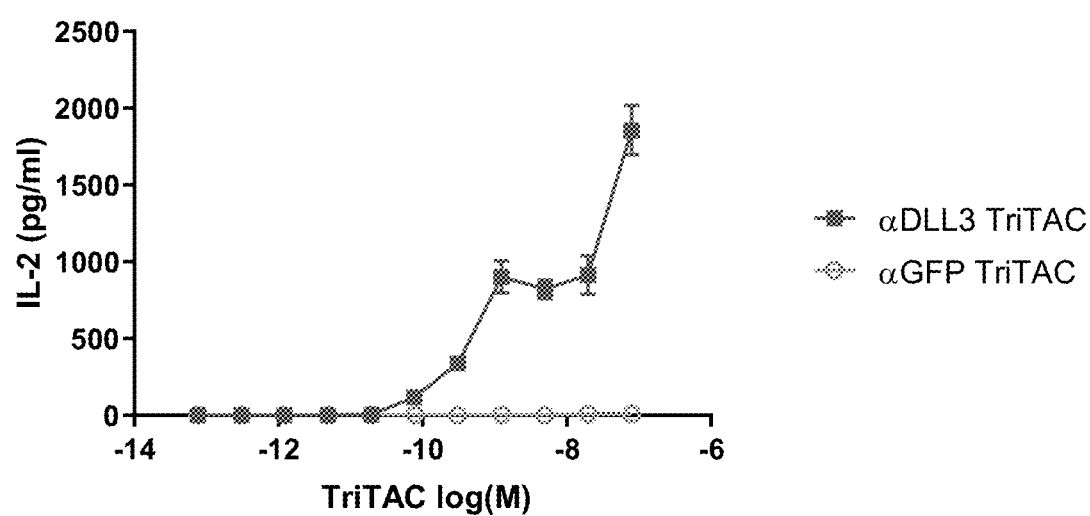
FIG. 48 illustrates the results of IL-2 measurements in conditioned media from co-cultures of T cells and NCI-H82 cells incubated with a titration of an exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA).
Figure 49:
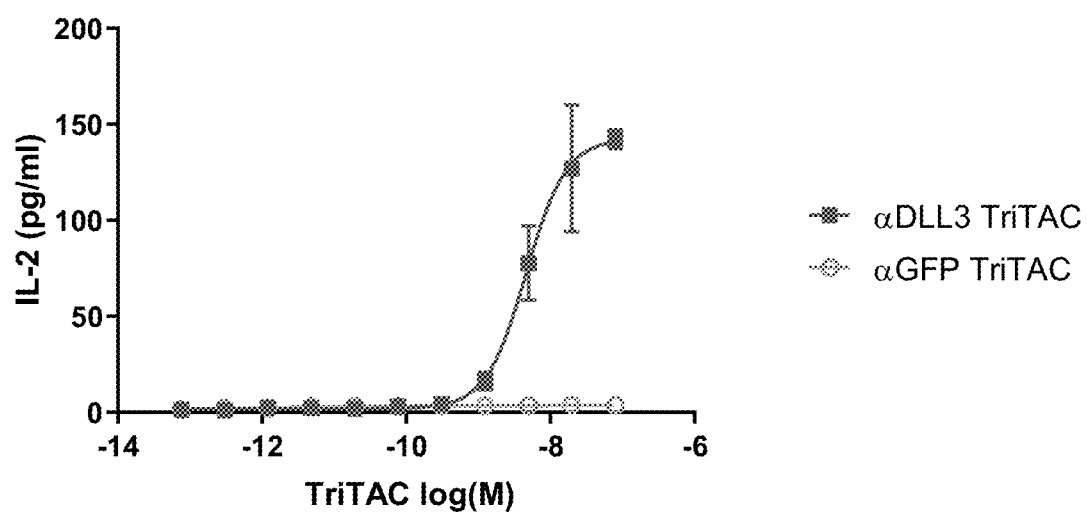
FIG. 49 illustrates the results of IL-2 measurements in conditioned media from co-cultures of T cells and SHP77 cells incubated with a titration of an exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA).
Figure 50:
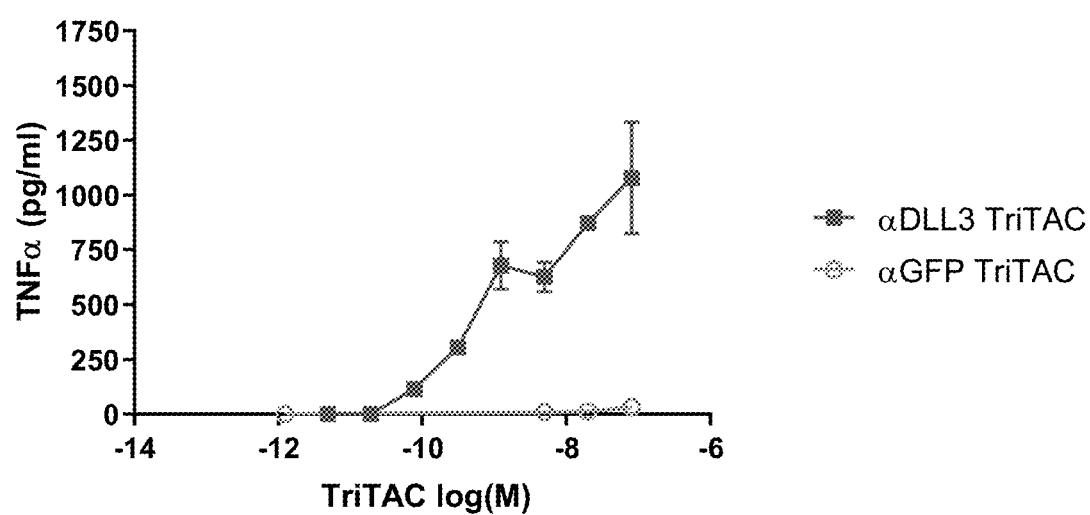
FIG. 50 illustrates the results of TNFα measurements in conditioned media from co-cultures of T cells and NCI-H82 cells incubated with a titration of an exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA).
Figure 51:
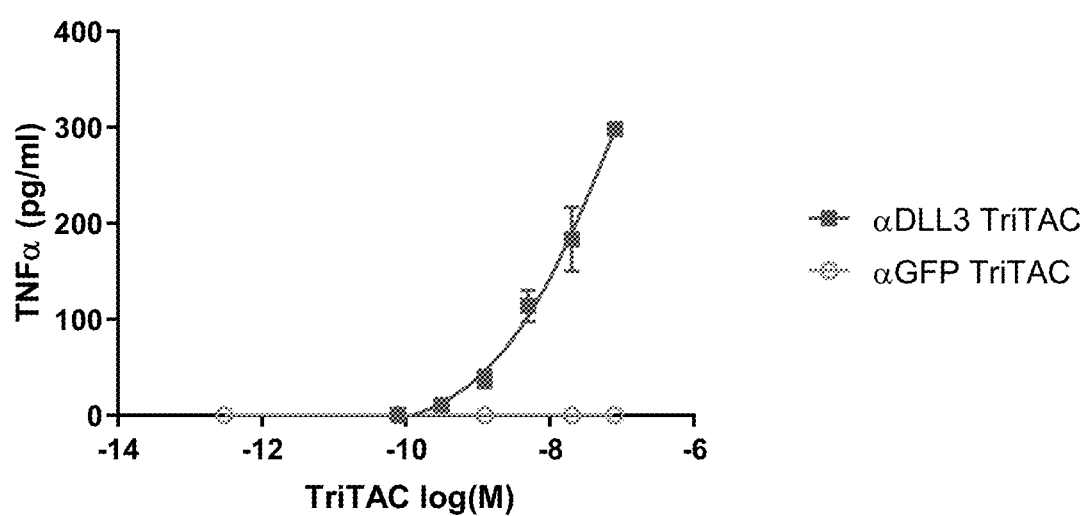
FIG. 51 illustrates the results of TNFα measurements in conditioned media from co-cultures of T cells and SHP77 cells incubated with a titration of an exemplary DLL3 targeting trispecific proteins containing DLL3 binding domain of this disclosure, 52D04, in an anti-DLL3:anti-ALB:anti-CD3 (TAC) configuration, tested in the presence of human serum albumin (HSA).
Figure 52:
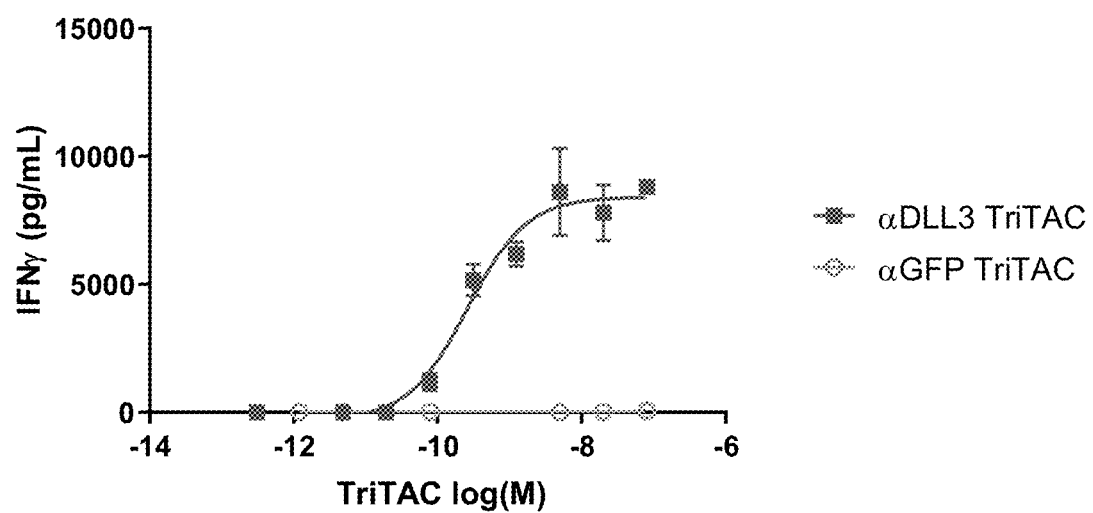
FIG. 52 illustrates the results of IFNγ measurements in conditioned media from co-cultures of T cells and NCI-H82 cells incubated with a titration of an exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA).
Figure 53:
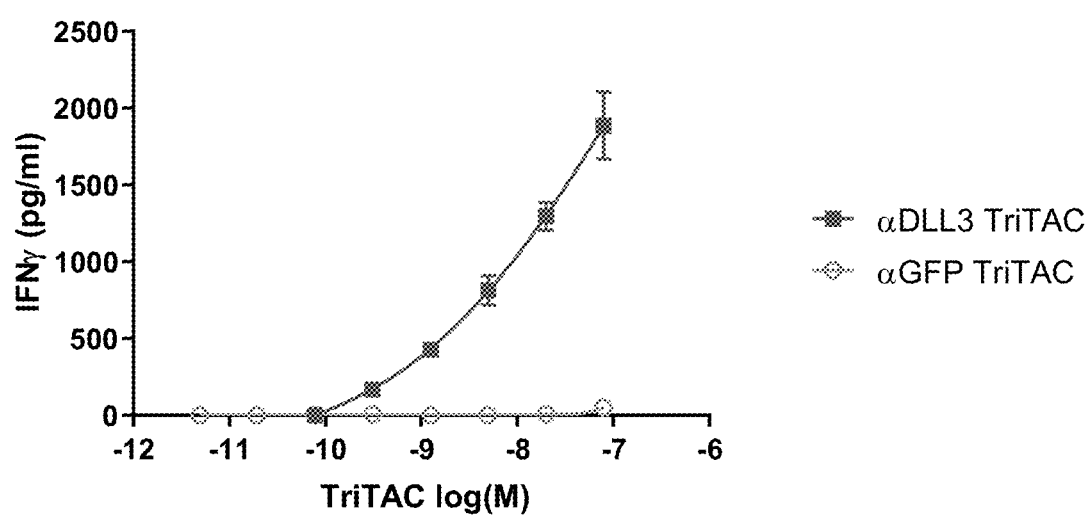
FIG. 53 illustrates the results of IFNγ measurements in conditioned media from co-cultures of T cells and SHP77 cells incubated with a titration of an exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA).
Figure 54:
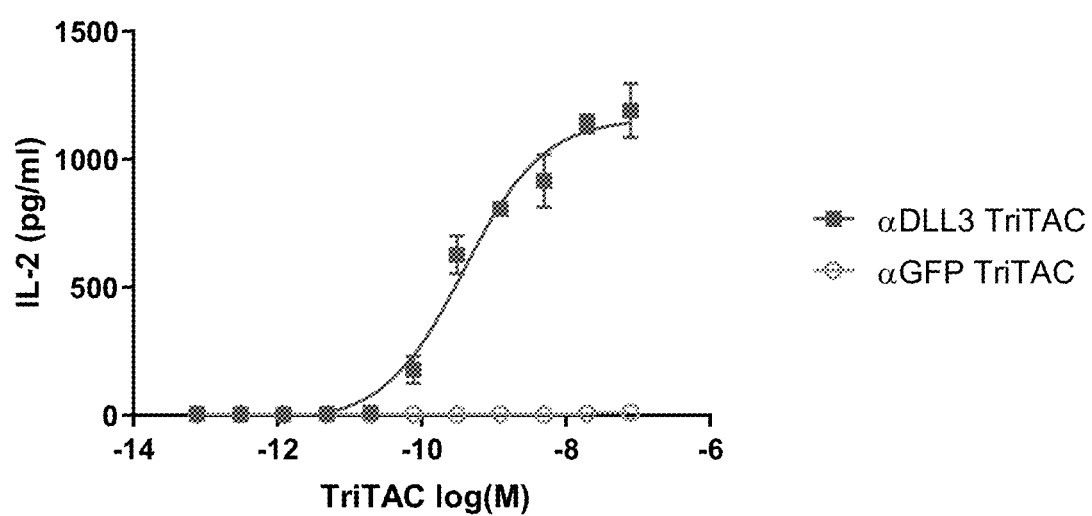
FIG. 54 illustrates the results of IL-2 measurements in conditioned media from co-cultures of T cells and NCI-H82 cells incubated with a titration of an exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA).
Figure 55:
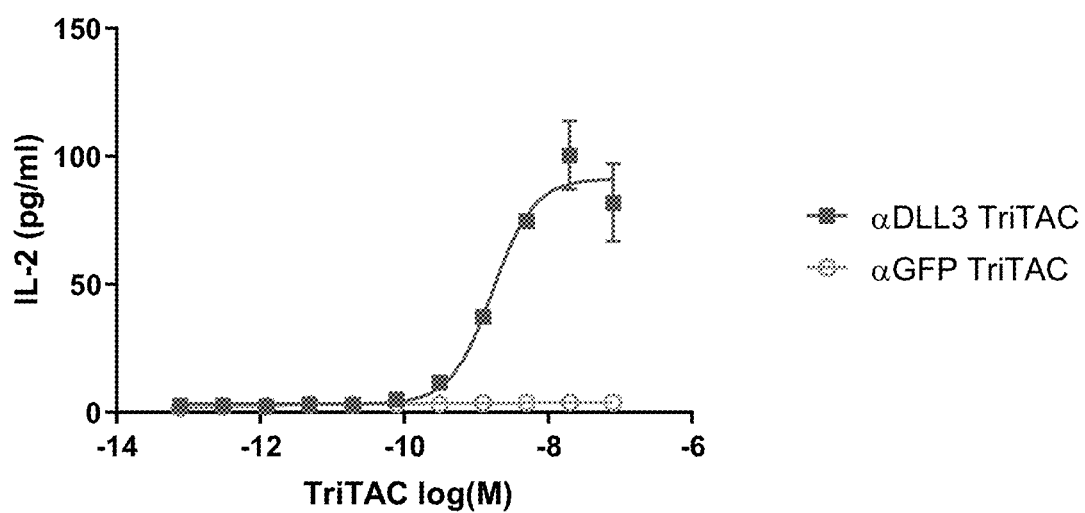
FIG. 55 illustrates the results of IL-2 measurements in conditioned media from co-cultures of T cells and SHP77 cells incubated with a titration of an exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA).
Figure 56:
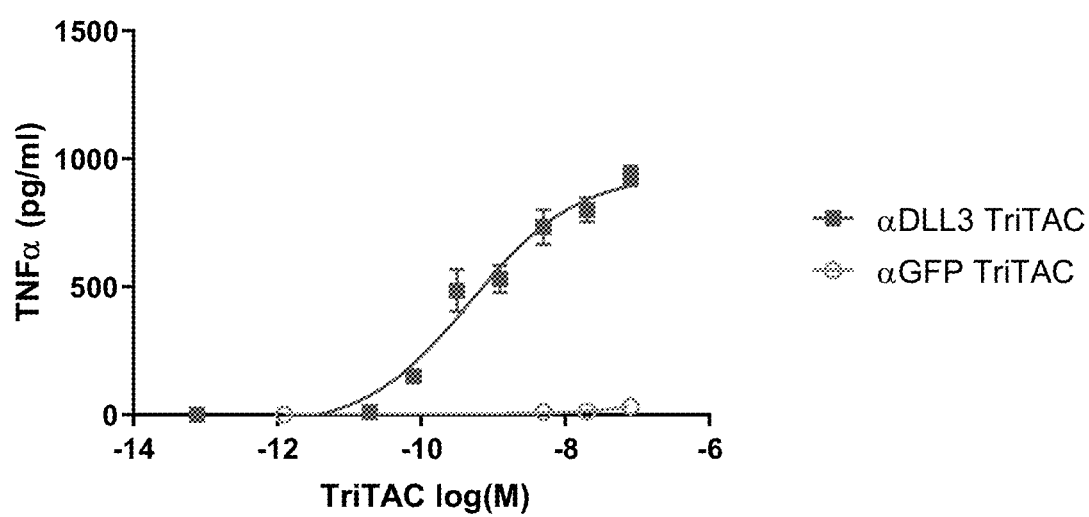
FIG. 56 illustrates the results of TNFα measurements in conditioned media from co-cultures of T cells and NCI-H82 cells incubated with a titration of an exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA).
Figure 57:
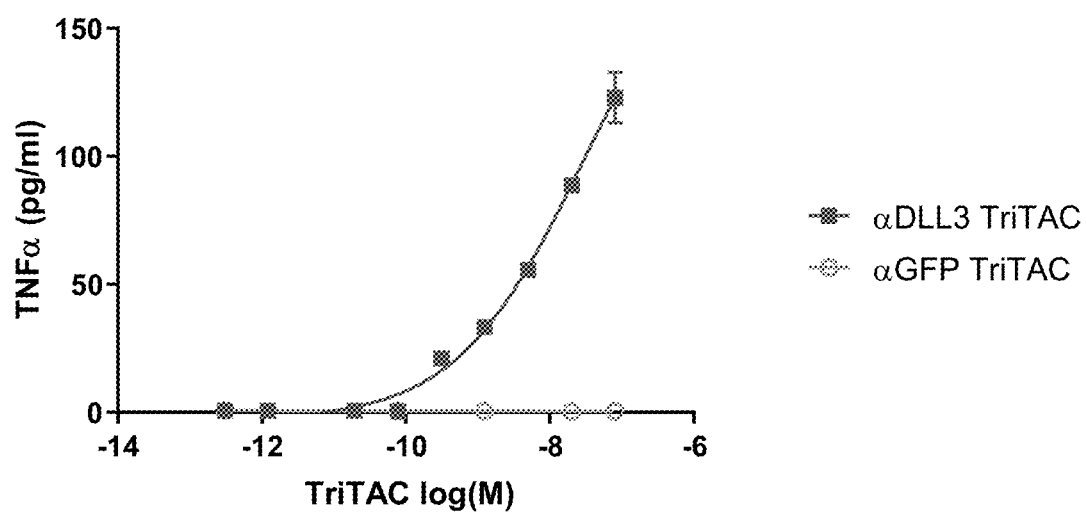
FIG. 57 illustrates the results of TNFα measurements in conditioned media from co-cultures of T cells and SHP77 cells incubated with a titration of an exemplary DLL3 targeting trispecific proteins containing DLL3 binding domain of this disclosure, 52D04, in an anti-CD3:anti-ALB:anti-DLL3 (CAT) configuration, tested in the presence of human serum albumin (HSA).

Example 12: DLL3 Dependent Cytokine Production by T Cells Induced by Exemplary DLL3 Targeting Trispecific Proteins In this assay, T cells from a healthy donor and NCI-H82 or SHP77 cells were incubated with exemplary DLL3 targeting trispecific molecules (in CAT or TAC configuration; SEQ ID No. 1890 and SEQ ID No. 1891) for 48 hours at 37° C. T cells from the same donor were also incubated for 48 hours at 37° C. with a control trispecific molecule, GFP TriTAC, which targets GFP and NCI-H82 or DMS53 cells. After 48 hours, conditioned media were collected, and the amount of various cytokines present in the conditioned media were measured using an electrochemiluminescent assay (Meso Scale Discovery). It was observed that IFNγ, IL-2, and TNFα were secreted into the medium in presence of NCI-H82 or SHP77 cells and DLL3 targeting trispecific molecules but not in presence the control GFP-targeting TriTAC molecule. For the DLL3 targeting trispecific molecule in TAC configuration: IFNγ production is shown in FIGS. 46 and 47; IL-2 production is shown in FIGS. 48 and 49; TNFα production is shown in FIGS. 50 and 51. For the DLL3 targeting trispecific molecule in CAT configuration: IFNγ production is shown in FIGS. 52 and 53; IL-2 production is shown in FIGS. 54 and 55; TNFα production is shown in FIGS. 56 and 57.

Figure 58:
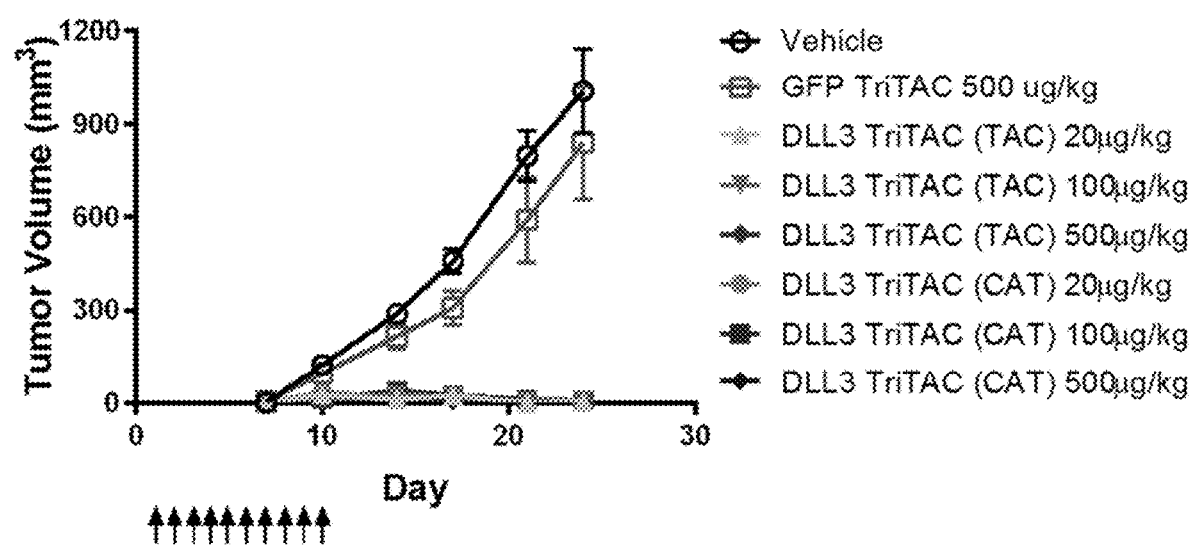
FIG. 58 depicts that an exemplary DLL3 targeting trispecific proteins containing DLL3 binding domain of this disclosure, 52D04, in an anti-DLL3:anti-ALB:anti-CD3 (TAC) configuration or an anti-CD3:anti-ALB:anti-DLL3 (CAT) configuration, was able to inhibit tumor growth in mice injected with a mixture of human T cells and NCI-H82 small cell lung cancer cells at dosages 20 µg/kg, 100 µg/kg or 500 µg/kg.

Example 13: Inhibition of Growth of NCI-1182 Xenografts by Exemplary DLL3 Targeting Trispecific Proteins For this study, 5×10$^6$ human T cells and 5×10$^6$ NCI-H82 small cell lung cancer cells were injected into mice at day 0. On days 1 to 10, mice were injected daily intraperitoneally (i.p.) with exemplary DLL3 targeting trispecific molecules (in CAT or TAC configurations; SEQ ID No. 1890 and SEQ ID No. 1891) at doses of 20, 100, or 500 μg/kg or negative control GFP-targeting TriTAC at a dose of 500 μg/kg. Tumor volumes were measured after every few days starting at day 7 and ending on day 24. Significant inhibition of tumor growth was observed in the mice injected with the DLL3-targeting trispecific proteins at all doses compared to mice dosed with the GFP-targeting TriTAC dosed at 500 μg/kg, as shown in FIG. 58.

Figure 59:
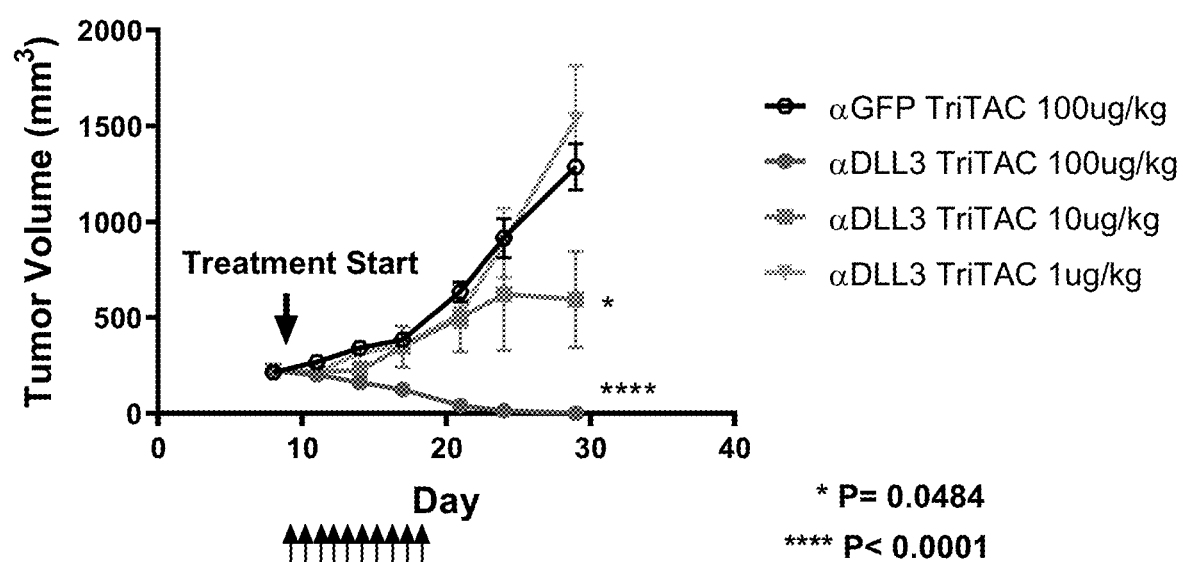
FIG. 59 depicts that an exemplary DLL3 targeting trispecific proteins containing DLL3 binding domain of this disclosure, 52D04, in an anti-CD3:anti-ALB:anti-DLL3 (CAT) configuration, was able to eliminate NCI-H82 xenograft tumors growth in mice injected with human T cells at dosages of 10 µg/kg and 100 µg/kg.

Example 14: Elimination NCI-1182 Xenografts by Exemplary DLL3 Targeting Trispecific Proteins For this study, 5×10$^6$ NCI-H82 small cell lung cancer cells were injected subcutaneously on day 0. Mice were randomized on day 8, and 2×10$^7$ human T cells were injected per mouse. On days 9 to 18, mice were injected daily i.p. with the exemplary DLL3 targeting trispecific molecules (in CAT configuration; SEQ ID No. 1890) at doses of 1, 10, or 100 μg/kg or negative control GFP-targeting TriTAC at a dose of 100 μg/kg. Tumor volumes were measured after every few days starting at day 8 and ending at day 29. Significant inhibition of tumor growth was observed in the mice injected with DLL3 targeting trispecific molecules at doses of 10 and 100 μg/kg compared to mice dosed with the GFP targeting TriTAC dosed at 100 μg/kg, as shown in FIG. 59.

Figure 60:
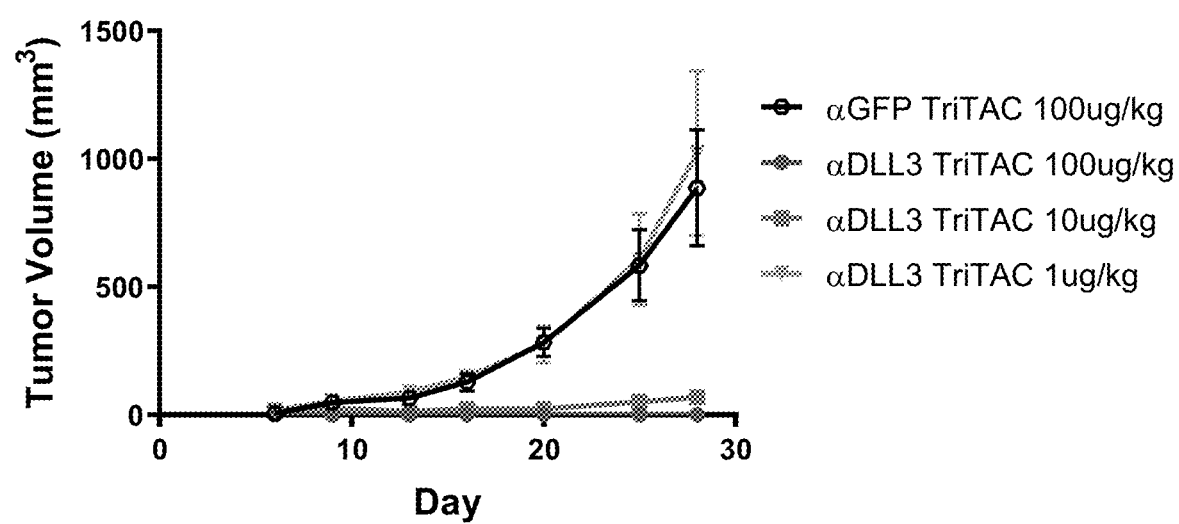
FIG. 60 depicts that an exemplary DLL3 targeting trispecific proteins containing DLL3 binding domain of this disclosure, 52D04, in an anti-CD3:anti-ALB:anti-DLL3 (CAT) configuration, was able to inhibit tumor growth in mice injected with a mixture of human T cells and SHP77 small cell lung cancer cells at dosages 10 µg/kg and 100 µg/kg.

Example 15: Inhibition of Growth of SHP77 Xenografts by Exemplary DLL3 Targeting Trispecific Proteins For this study, 5×10$^6$ human T cells and 1×10$^7$ SHP77 small cell lung cancer cells were injected into mice at day 0. On days 1 to 10, mice were injected daily i.p. with DLL3 targeting trispecific molecules (in CAT configuration; SEQ ID No. 1890) at doses of 1, 10, or 100 μg/kg or negative control GFP-targeting TriTAC at a dose of 100 μg/kg. Tumor volumes were measured after every few days starting at day 6 and ending on day 28. Significant inhibition of tumor growth was observed in the mice injected with DLL3-targeting trispecific molecules at doses of 10 and 100 μg/kg compared to mice dosed with the GFP-targeting TriTAC dosed at 100 μg/kg, as shown in FIG. 60.

Figure 61:
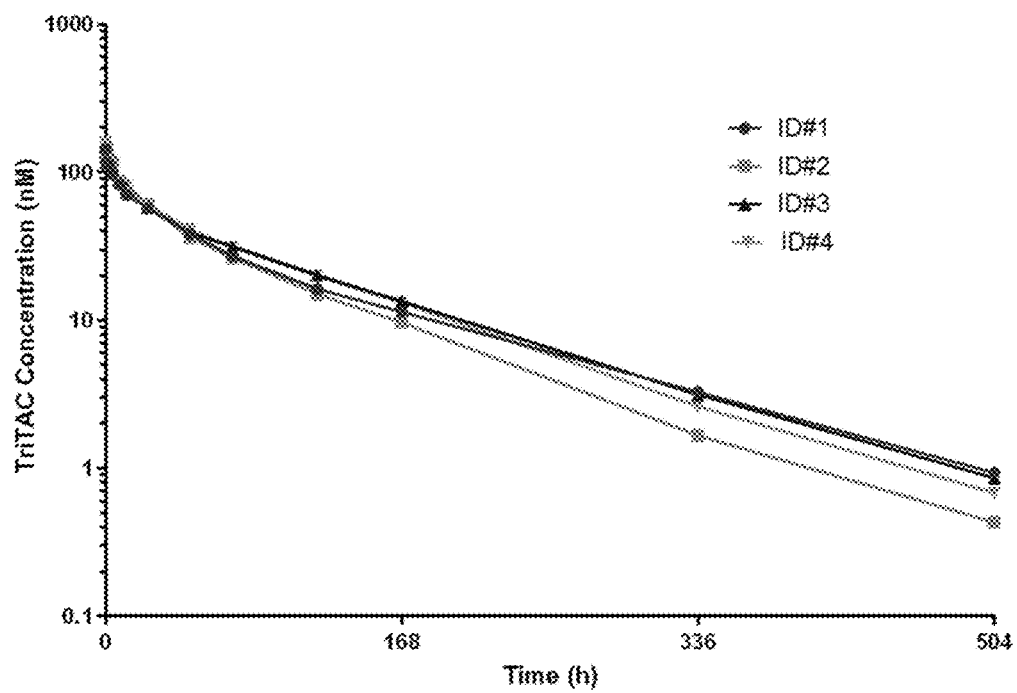
FIG. 61 depicts pharmacokinetic profile of exemplary DLL3 targeting trispecific proteins containing DLL3 binding domain of this disclosure, 52D04, in an anti-CD3:anti-ALB:anti-DLL3 (CAT) configuration (ID numbers 1 and 2) or an anti-DLL3:anti-ALB:anti-CD3 (TAC) configuration (ID numbers 3 and 4). Serum levels of the DLL3 targeting trispecific proteins at various time points following injection into cynomolgus monkeys, at 0.3 mg/kg, are shown in the plot.

Example 16: Pharmacokinetic Profile of Exemplary DLL3 Targeting Trispecific Proteins DLL3-targeting trispecific proteins have a half-life of ~3 to ~3.9 days in cynomolgus monkeys when dosed at 0.3 mg/kg For this study, cynomolgus monkeys were injected with 0.3 mg/kg doses of exemplary DLL3-targeting trispecific molecules (in CAT or TAC configurations; SEQ ID No. 1890 and SEQ ID No. 1891), intravenously, and serum samples were collected at various time points after the injection. Two monkeys were injected for each dose. The amount of DLL3 targeting trispecific molecule in the serum was measured using anti-idiotype antibodies recognizing the trispecific molecule, in an electrochemiluminescent assay. FIG. 61 shows a plot for the serum DLL3 targeting trispecific molecule levels at various time points. The data was then used to calculate the pharmacokinetic properties of the DLL3 targeting trispecific molecules, as provided in Table 15. Human dosing schedule of once or twice a week is contemplated based on the pharmacokinetic data.

TABLE 15

Pharmacokinetics of exemplary DLL3 targeting trispecific molecules

| ID | Half life (h) | AUC 0-inf (h*nM) | CL (L/h/kg) | Vss (l/kg) |
|---|---|---|---|---|
| 1 | 93.1 | 7210 | 0.000832 | 0.0869 |
| 2 | 72.4 | 6690 | 0.000896 | 0.0731 |
| 3 | 82.6 | 7900 | 0.00076 | 0.0767 |
| 4 | 77 | 7890 | 0.00076 | 0.0712 |

Figure 62:
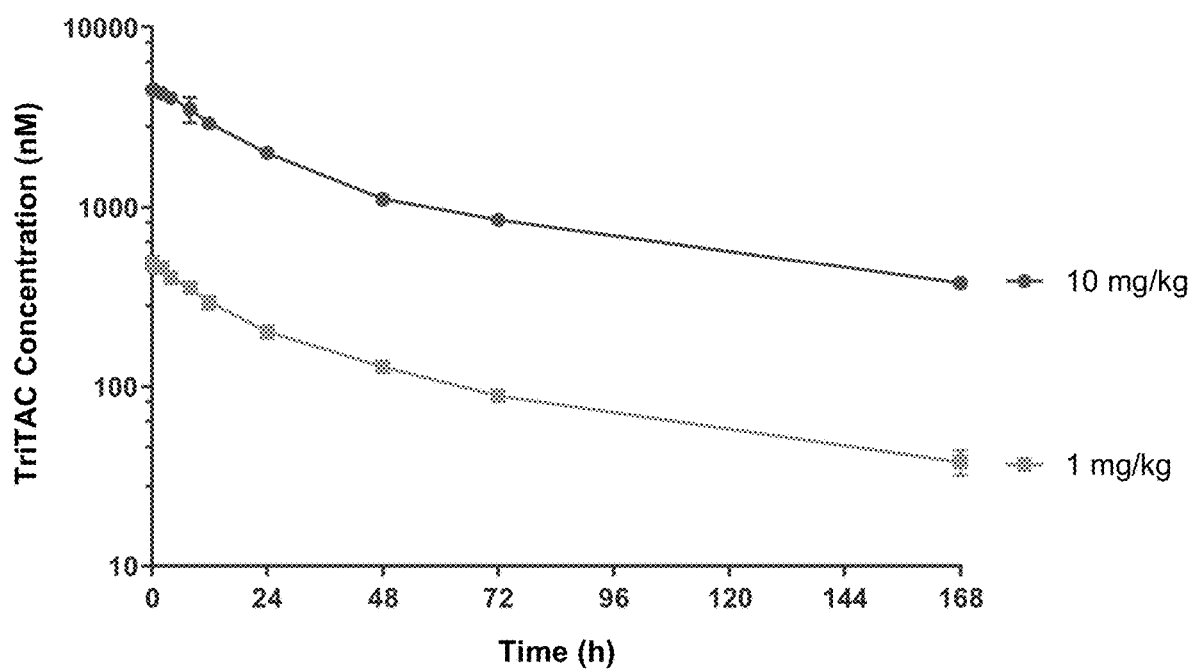
FIG. 62 depicts pharmacokinetic profile of an exemplary DLL3 targeting trispecific proteins containing DLL3 binding domain of this disclosure, 52D04, in an anti-CD3:anti-ALB:anti-DLL3 (CAT) configuration, at various time points following injection into cynomolgus monkeys, at 1 mg/kg or 10 mg/kg, are shown in the plot.

DLL3 targeting trispecific protein has a half-life of ~2.8 to ~3.3 days in cynomolgus monkeys when dosed at 1 or 10 mg/kg:

For this study, cynomolgus monkeys were injected with 1 mg/kg or 10 mg/kg dose of exemplary DLL3 targeting trispecific molecules, intravenously, and serum samples were collected at various time points after the injection. Two monkeys were injected for each dose. The amount of DLL3-targeting TriTAC in the serum was measured using anti-idiotype antibodies recognizing the TriTAC molecule, in an electrochemiluminescent assay. FIG. 62 shows a plot for the serum DLL3 targeting trispecific molecule levels at various time points. The data was then used to calculate the pharmacokinetic properties of the TriTAC molecule, as provided in Table 16. The pharmacokinetic data suggest that once or twice weekly dosing in humans.

TABLE 16

Pharmacokinetics of exemplary DLL3 targeting trispecific molecules

| Dose (mg/kg) | Half life (h) | $C_{max}$ (nM) | AUC 0-inf (h*nM) | CL (mL/h/kg) | Vss (l/kg) |
|---|---|---|---|---|---|
| 1 | 67.5 | 493 | 23,800 | 0.79 | 63.8 |
| 10 | 78.6 | 4,492 | 236,500 | 0.80 | 71.9 |

Figure 63:
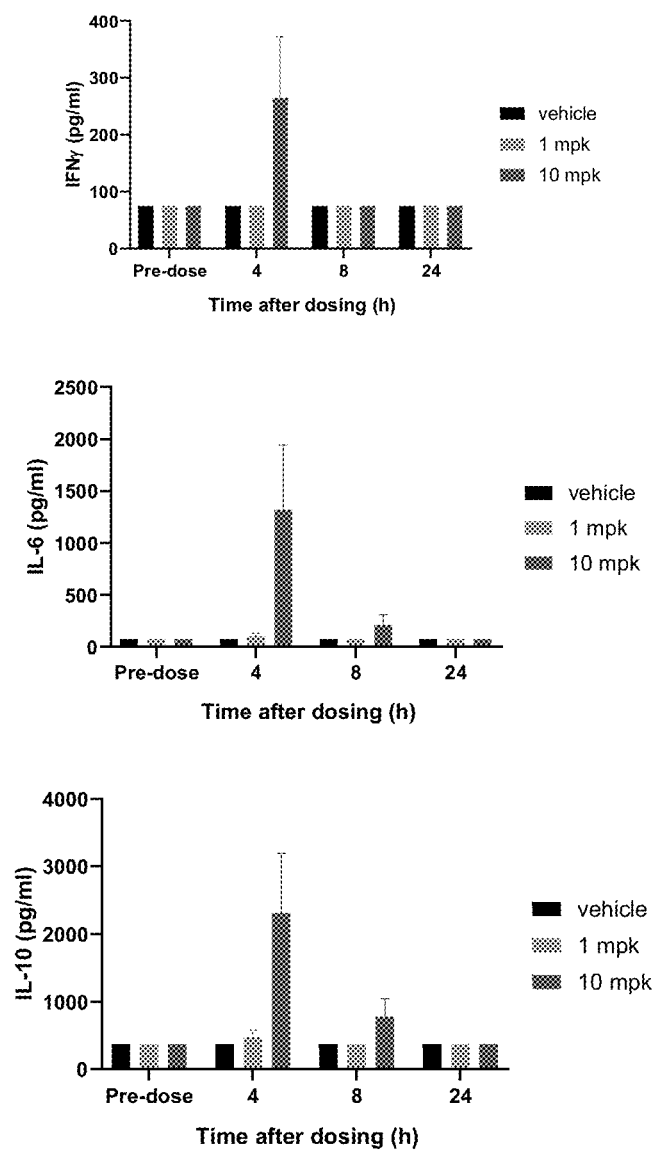
FIG. 63 depicts transient cytokine increase after first dosing of an exemplary DLL3 binding TriTAC molecule of this disclosure at 1 mg/kg and 10 mg/kg or a vehicle control. The top panel shows transient increase of IFNγ, the second panel shows transient increase of IL-6, and third panel show transient increase in IL-10.

Exemplary DLL3 targeting trispecific proteins were tolerated in cynomolgus monkeys when given as a single dose up to 10 mg/kg:

A transient increase in serum cytokine levels were observed, mainly at 10 mg/kg dosage of administration of exemplary DLL3 targeting trispecific protein (in CAT configuration) (FIG. 63; IFNγ-FIG. 63 top panel, IL-6 FIG. 63 second panel; IL-10 FIG. 63 third panel). Transient T cell margination and T cell activation were also observed (data not shown). At terminal and recovery euthanasia, no DLL3 trispecific protein-related macroscopic findings or organ weight differences were observed, and at recovery euthanasia, no DLL3 trispecific protein-related microscopic findings were observed.

Figure 64:
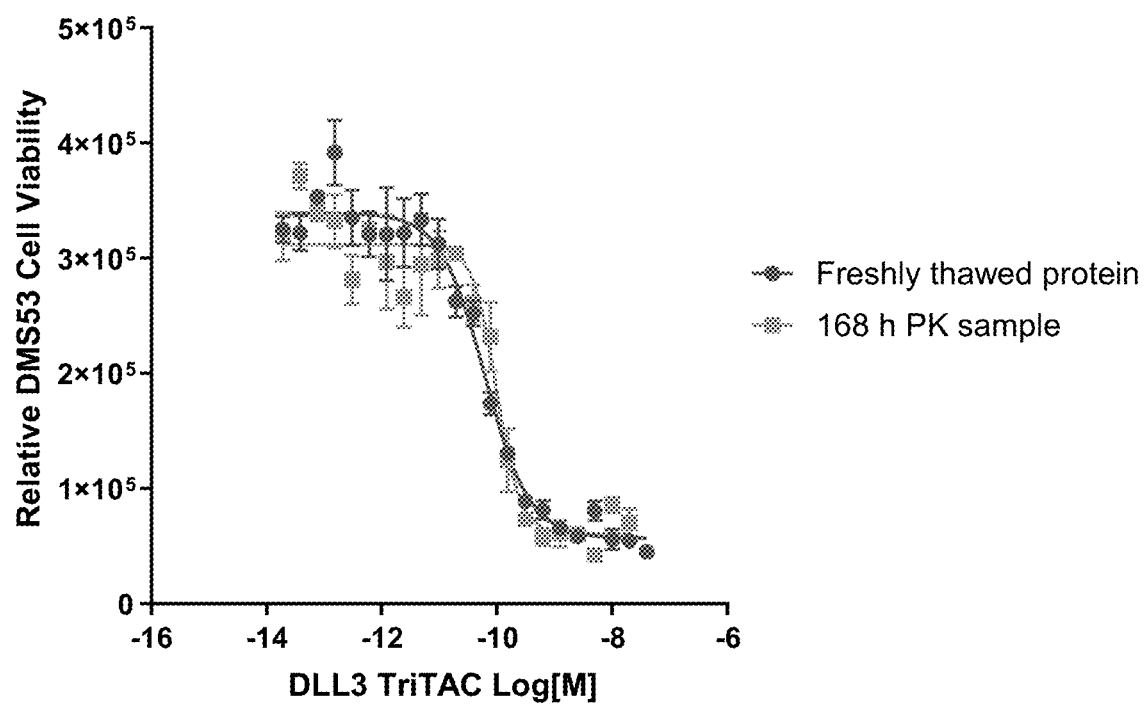
FIG. 64 illustrates the results of a TDCC assay on DMS53 cells, using exemplary DLL3 targeting trispecific proteins containing DLL3 binding domain of this disclosure, 52D04, in an anti-CD3:anti-ALB:anti-DLL3 (CAT) configuration, using freshly thawed protein, or using protein present in a serum sample from a cynomolgus monkey collected 168 h after dosing with 10 mg/kg DLL3 targeting trispecific protein, measured in the presence of 8.4% cynomolgus monkey serum.

To demonstrate the DLL3-targeting TriTAC retained cell directed killing activity after being administered to a cynomolgus monkey, a serum sample form the 10 mg/kg dose group collected at 168 h after dosing was tested in a DMS53 TDCC assay and was compared to DLL3-targeting TriTAC that was freshly thawed. Identical cell DMS53 cell killing was observed with the serum sample and the freshly thawed protein (FIG. 64), indicating the DLL3-targeting TriTAC retains the ability to direct T cells to kill target cells 1 week after being dosed in a cynomolgus monkey.

Example 17: Xenograft Tumor Model

An exemplary anti-DLL3 targeting trispecific protein of this disclosure is evaluated in a xenograft model.

Female immune-deficient NOD/scid mice are sub-lethally irradiated (2 Gy) and subcutaneously inoculated with $1 \times 10^6$ NCI-H28 cells into their right dorsal flank. When tumors reach 100 to 200 mm$^3$, animals are allocated into 3 treatment groups. Groups 2 and 3 (8 animals each) are intraperitoneally injected with $1.5 \times 10^7$ activated human T-cells. Three days later, animals from Group 3 are subsequently treated with a total of 9 intravenous doses of exemplary DLL3 trispecific antigen-binding protein of (such as 1, 10, 50, or 100 μg/kg) (qd×9d). Groups 1 and 2 are only treated with vehicle. Body weight and tumor volume are determined for 30 days.

It is expected that animals treated with the exemplary DLL3 targeting trispecific proteins of the previous examples have a statistically significant delay in tumor growth in comparison to the respective vehicle-treated control group.

Example 18: Proof-of-Concept Clinical Trial Protocol for Administration of an Exemplary DLL3 Trispecific Antigen-Binding Protein (Anti-DLL3 Trispecific Protein) to Neuroendocrine Cancer Patients This is a Phase I/II clinical trial for studying an exemplary DLL3 trispecific antigen-binding protein as a treatment for a Neuroendocrine Cancer.

Study Outcomes:
Primary: Maximum tolerated dose of the exemplary DLL3 targeting trispecific protein
Secondary: To determine whether in vitro response of the exemplary DLL3 targeting trispecific proteins are associated with clinical response
Phase I
The maximum tolerated dose (MTD) will be determined in the phase I section of the trial.
 1.1 The maximum tolerated dose (MTD) will be determined in the phase I section of the trial.
 1.2 Patients who fulfill eligibility criteria will be entered into the trial to evaluate the exemplary DLL3 targeting trispecific protein.
 1.3 The goal is to identify the highest dose of the exemplary anti-DLL3 trispecific protein that can be administered safely without severe or unmanageable side effects in participants. The dose given will depend on the number of participants who have been enrolled in the study prior and how well the dose was tolerated. Not all participants will receive the same dose.
Phase II
 2.1 A subsequent phase II section will be treated at the MTD with a goal of determining if therapy with therapy of the exemplary DLL3 targeting trispecific proteins results in at least a 20% response rate.
Primary Outcome for the Phase II—To determine if therapy with the exemplary DLL3 targeting trispecific protein trispecific protein results in at least 20% of patients achieving a clinical response (blast response, minor response, partial response, or complete response)
Eligibility: Biopsy proven neuroendocrine tumor, which is somatostatin receptor positive as demonstrated on somatostatin receptor PET.

All sites or origin are eligible.
Functional and nonfunctional tumors are allowed.
Not a candidate for surgical debulking.
ECOG performance status 0, 1 or 2
Age>18.
Ability to understand a written informed consent document, and the willingness to sign it.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

| SEQ. ID NO. | name | sequence |
|---|---|---|
| 1 | DL1 | QVQLQESGGGLVQAGGSLRLSCAASGSIFSIASMGWYRQAPGKQRELVAVITSFSSTNYADSVKGRFTISRDNAKNTVYLQMNSLKPEDTGVYYCNARYFERTDWGQGTQVTVSS |
| 2 | DL74 | QVQLQESGGGLVQAGGSLRLSCAAPGSIFSIASMGWYRQAPGKQRELVAVITSFSSTNYADSVKGRFTISRDNAKNTVYLQMNSLKPEDTGVYYCNARYFERTDWGQGTQVTVSS |
| 3 | DL31 | QVQLQESGGGLVQAGGSLRLSCAASGSIFSIASMAWYRQAPGKQRELVAAITSFSSTNYADSVKGRFTISRDNAKNTVYLQMNSLKPEDTGVYYCNARYFERTDWGQGTQVTVSS |
| 4 | DL3 | QVQLQESGGGLVQAGGSLRLSCAASESIFSINVMAWHRQAPGKQRELVARITSGGSTNYADSVKGRFTISRDNAKNTVYLQMNSLKPEDTGVYYCGAYQGLYAYWGQGTQVTVSS |
| 5 | DL80 | QVQLQESGGGLVQAGGSLRLSCVASGSSFSITSMAWYRQAPGKQRDLVAAITSFGSTNYADSVKDRFTISRDNAKNTVYLQMNSLKPEDTAVYYCNGRVFDHVYWGQGTQVTVSS |
| 6 | DL18 | QVQLQESGGGLVQAGGSLKLSCAASSSIFSISSMSWYRQAPGKQRELVAAITTFDYTNYADSVKGRFTISRDNAKNMMYLQMNSLKPEDTAVYLCNARAFGRDYWGQGTQVTVSS |
| 7 | DL94 | QVQLQESGGGLVQAGGSLKLSCAASSSIFSISSMSWYRQAPGKQRELVAAITSFGSTNYADSVKGRFTISRDNAKNMMYLQMNSLKPEDTAVYRCNARTMGRDYWGQGTQVTVSS |
| 8 | DL17 | QVQLQESGGGLVQPGGSLRLSCAASGSTLNIKIMAWHRQAPGKQRELVATLTSGGNTNYADSVKGRFTISRDNAKNTVYLQMNSLQPEDTAVYYCGLWDGVGGAYWGRGTQVTVSS |
| 9 | DL46 | QVQLQESGGGLVQPGGSLRISCAASGSTLNIKIMAWHRQAPGKQRELVATLTSGGNTNYADSVKGRFTISRDNAKNTVYLQMNSLQPEDTAVYYCGLWDGVGGAYWGRGTQVTVSS |
| 10 | DL15 | QVQLQESGGGLVQAGGSLRLSCAASGSTFNIKTMAWHRQAPGNQRELVATLTSGGNTNYADSVKGRFTISRDNAKNTVYLQMNSLKPEDTAVYYCGLWNGVGGAYWGRGTQVTVSS |
| 11 | DL26 | QVQLQDGGGLVQPGGSLRLSCAASGSTFNIKLMAWHRQAPGNQRELVATLTSGGNTNYADSVKGRFTISRDNASNIVYLQMNSLKPEDTAVYYCGLWDGVGGAYWGRGTQVTVSS |
| 12 | DL83 | QVQLQESGGGLVQAGGSLRLSCAASGSTFNFKIMAWHRQAPGKQRELVASLTSEGLTNYRDSVKGRFTISRDNAKNTVYLQMNNLKPEDTAVYYCGLWDGVGGAYWGRGTQVTVSS |
| 13 | DL5 | QVQLQESGGGLVQPGGSLRLSCAASGFMFSSYSMSWYRQAPGKQRELVAAITTWGSTNYADSVKGRFTISRDNAKNTVWLQMNSLEPEDTAVYFCNARSWNNYWGQGTQVTVSS |
| 14 | DL22 | QVQLQESGGGLVQVGGSLRLSCAASGFMFSSYSMSWYRQAPGKQRELVAAITSYGSTNYADSVKGRFTISRDNAKNTVWLQMNSLKPEDTAVYFCNARSWNNYWGQGTQVTVSS |
| 15 | DL85 | QVQLQESGGGLVQPGGSLRLSCAASGFTFSSHSMSWYRQAPGKQRELVAAITTYGSTNYIDSVKGRFTISRDNTKNTVYLQMNSLKPEDTAVYFCNARSWNNYWGQGTQVTVSS |
| 16 | DL69 | QVQLQESGGGLVQAGGSLRLSCVASGSSFSHNTMGWYRQAPGKQRDLVARITTFGTTNYADSVKGRFTISRDNAKNTVYLQMNSLKPEDTAVYYCNGESFGRIWYNWGQGTQVTVSS |
| 17 | DL27 | QVQLQESGGGLVQAGASLRLTCTASGGRFSYATMGWSRQAPGKQREMVARITSSGFSTNYADSVKGRFTISRDNAKNAVYLQMDSLKPEDTAVYYCNAQHFGTDSWGQGTQVTVSS |
| 18 | DL51 | QVQLQESGGGLVQAGASLRLTCTASGSRFSYATMGWSRQAPGKQRELVARITSSGFSTNYADSVKGRFTISRDNAKNAVYLQMDSLKPEDTAVYYCNAQQFGTDSWGQGTQVTVSS |
| 19 | DL54 | QVQLQESGGGLVQAGGSLRLSCAASGSTFTSNVMGWHRQAPGKQRELVANMHSGGSTNYADSVKGRFTISRDNAKNIVYLQMNNLKIEDTAVYYCRWYGIQRAEGYWGQGTQVTVSS |
| 20 | DL11 | QVQLQESGGGLVVAGGSLRLSCAASGSSVSFLSMAWYRQAPGKKRELVAGISVDGSTNYADSVKGRFTVSRDNAKNTVYLQMNSLQPEDTAVYYCYAYRWVGRDTYWGQGTQVTVSS |
| 21 | DL19 | QVQLQESGGGLVVAGGSLRLSCAASGSSVSFLSMAWYRQAPGKKRELVAGISVDGSTNYADSVKGRFTISRDNAKNTVYLQMNSLQPEDTAVYYCYAYRWVGRDTYWGQGTQVTVSS |

-continued

| 22 | DL68 | QVQLQESGGGLVVSGGSLRLSCAASGSSVSFLSMAWYRQAPGKKRELVAGISVDGSTNYAD SVKGRFTISRDNAKNTVYLQMNSLQPEDTAAYYCYAYRWVGRDTYWGQGTQVTVSS |
| --- | --- | --- |
| 23 | DL14 | QVQLQESGGGLVVAGGSLRLSCAASGSSVSFLSMAWYRQAPGKKRELVAGISVDGSTNYAD SVKGRFTISRDNAENTVYLQMNSLQPEDTAVYYCYAYRWEGRDTYWGQGTQVTVSS |
| 24 | DL67 | QVQLQESGGGLVVAGGSLRLSCAASGSSVSFLSMAWYRQAPGKKRELVAGISVDGSTNYAD SVKGRFTISRDNAENTVYLQMNSLQPEDTAVYYCYAYRWEGRNTYWGQGTQVTVSS |
| 25 | DL56 | QVQLQESGGGLVQPGGSLRLSCAASGSSVSFLSMAWYRQAPGKKRELVAGISTDGSTNYVD SVKGRFTISRDNAKNTVYLQMNSLQPEDTAVYYCYAYRWVGRYTYWGQGTQVTVSS |
| 26 | DL13 | QVQLQESGGGLVVAGGSLRLSCAASGSSVSFLSMAWYRQAPGKKRELVAGISTDGTTNYVD SVKDRFTISRDNAKNTVYLQMNSLQPEDTAAYYCYAYRWVGRDTYWGQGTQVTVSS |
| 27 | DL77 | QVQLQESGGGLVVAGGSLRLSCAASGSSVSFLSIAWYRQAPGKKRELVAGISTDGTTNYVD SVKDRFTISRDNAKNTVYLQMNSLQPEDTAAYYCYAYRWVGRDTYWGQGTQVTVSS |
| 28 | DL79 | QVQLQESGGGLVQAGGSLTLSCAASGSSVSFLSMAWYRQAPGKKRELVAGISTDGTTNYVD SVKDRFTISRDNAKNTVYLQMNSLQPEDTAAYYCYAYRWVGRDTYWGQGTQVTVSS |
| 29 | DL20 | QVQLQESGGGLVQAGGSLRLSCAASGSSVSFLSMAWYRQAPGKKRELVAGISTDGSTNYAD SVKGRFTISEGNAKNTVDLQMNSLQPEDTAVYYCYAYRWVDRYTYWGQGTQVTVSS |
| 30 | DL41 | QVQLQESGGGLVVAGGSLRLSCAASGSSVSFLSMAWYRQAPGKKRELVAGISTDGSTNYAD SVKGRFTISEDNAKNTVDLQMNSLQPEDTAVYYCYAYRWIDRYTYWGQGTQVTVSS |
| 31 | DL59 | QVQLQESGGGLVQPGGSLRLSCAASGSSVSFLSMAWYRQAPGKKRELVAGISTDGSTNYAD SVKGRFTISEDNAKNTVDLQMNSLQPEDTAVYYCYAYRWVDRYTYWGQGTQVTVSS |
| 32 | DL16 | QVQLQESGGGLVVAGGSLRLSCAASGSSVSFLSMAWYRQAPGKKRELVAGISSDGSTNYVD SVKGRFTISRDNAKNIVFLQMNSLQPQDTAVYYCYAYRWVGRDTYWGQGTQVTVSS |
| 33 | DL6 | QVQLQESGGGLVVAGGSLRLSCAASGSSVSFLSMAWYRQAPGKKRELVAGISADGSTDYID SVKGRFTISRDSANNTMYLQMNSLQPEDTAVYYCYAYRWTTRYTYWGQGTQVTVSS |
| 34 | DL84 | QVQLQESGGGLVQPGGSLRLSCAASGFTLDYYAIGWYRQAPGKKRELVAGISSDGSTHYVD SVKGRFAISRDNAENTVYLQMNDLQPDDTAVYYCYAYRWVGGYTYWGQGTQVTVSS |
| 35 | DL2 | QVQLQESGGGLVQAGGSLRLSCVASGSTSSINAMGWYRRAPGKQRELVAGISSDGSKNYAD SVKGRFTISRDNAKNTVYLQMNSLKPEDTAVYYCYYFRTVAASSMQYWGQGTQVTVSS |
| 36 | DL43 | QVQLQESGGGLVQAGGSLRLSCVASGSTSSINAMGWYRRAPGKQRELVAGISSDGSKVYAD SVKGRFTISRDNAKNTVYLQMNSLKPEDTAVFYCYYFRTVSGSSMRYWGQGTQVTVSS |
| 37 | DL92 | QVQLQESGGGLVQAGGSLRLSCAASGITSSVYSMGWYRQAPGKQRELVAGSSSDGSTHYVD SVRGRFTISRDNAKNTVYLQMSSLKPEDTAVYYCYANRGFAGAPSYWGQGTQVTVSS |
| 38 | DL10 | QVQLQESGGGLVQAGGSLRLSCAASGRTSMFNSMGWHRQAPGKQRELVAIIRSGGSSNYAD TVKGRFTISRDNTKNTVYLQMNDLKPEDTAVYYCFYYFQSSYWGQGTQVTVSS |
| 39 | DL82 | QVQLQESGGGLVQAGGSLRLSCAASGRTSMVNSMGWHRQAPGKQRELVALITSGGSSNYAD TVKGRFTISRDNTKNTVYLQMNDLKPEDTAVYYCFYYFQSSYWGQGTQVTVSS |
| 40 | DL23 | QVQLQESGGGLVQAGGSLRLSCAASGSVSMFNSMGWHRQPPGKQRELVAIITSGGSSNYAD TVKGRFTISRDNTKNTVYLQMNDLKPEDTAVYYCFYYFQSSYWGQGTQVTVSS |
| 41 | DL42 | QVQLQESGGGLVQAGGSLRLSCTASGSIFSIAVMGWYRQVPGKRREWVATIFDGSYTNYAD SVKGRFTISRDNARNKVYLQMNNLKPEDTAVYYCQTHWTQGSVPKESWGQGTQVTVSS |
| 42 | DL45 | QVQLQESGGGLVQAGGSLRLSCVASSGIFSDMSMVWYRQAPGKQRELVASITTFGSTNYAD PVKGRFTISRDNAKNTVYLQMNSLKPEDTAVYYCSGRSYSSDYWGRGTQVTVSS |
| 43 | DL58 | QVQLQESGGGLVQAGGSLRLSCVASGSISSIIVMGWSRQAPGKQRESVATITRDGTRNYAD SLKGRFTISRDNAKNTSYLQINSLKPEDTAVYSCYARYGDINYWGKGTQVTVSS |
| 44 | DL70 | QVQLQESGGGLVQAGGSLRLSCVASGSISSIIVMGWSRQAPGKQRESLATISRGGTRTYAD SVKGRFTISRDNAKNTSYLQMNSLKPEDTAVYSCYARYGDINYWGKGTQVTVSS |
| 45 | DL89 | QVQLQESGGGLVQAGGSLRLSCVASGSIFTTNSMGWHRQGPGKQRELVALIGSAGSTKYAD SVKGRFTISRDNAKNTVSLQMDSLKPEDTAVYYCFYYDSRSYWGQGTQVTVSS |
| 46 | DL38 | QVQLQESGGGMVQPGGSLRLSCAASGSREISTMGWHRQAPGKQRELAARITSGGITKYADS VKGRFTISRDNAKKTVYLQMNSLKSEDTAVYYCFAYDNINAYWGQGTQVTVSS |
| 47 | DL52 | QVQLQESGGGWVQAGGSLRLSCAASGSREISTMGWHRQAPGKQRELAARITSGGITKYADS VKGRFTISRDNAKKTVYLQMNSLKSEDTAVYYCFAYDNINAYWGQGTQVTVSS |

| 48 | DL64 | QVQLQESGGGWVQAGGSLRLSCTASGSREISTMGWHRQAPGKQRELAARITSGGITKYADS VKGRFTISRDNAKKTVYLQMDSLKSEDTAVYYCFAYDNINAYWGQGTQVTVSS |
|---|---|---|
| 49 | DL33 | QVQLQESGGGSVQAGRSLGLSCAASGSREISTMGWHRQAPGKQRELAARITSGGITKYADS VKGRFTISRDNAKKTVYLQMNSLKSEDTAVYYCFAYDNINAYWGQGTQVTVSS |
| 50 | DL12 | QVQLQESGGGLVQAGGSLRLSCTASGSIFRGAAMYWHRQAPGKQRELVAAITTSGNTSYAD SVKGRFTISRDNAKNTMYLQIISLKPEDTAVYYCAFWIAGKAYWGQGTQVTVSS |
| 51 | DL29 | QVQLQESGGGLVQPGGSLRLSCAASGSISSFNFMSWHRQAPGKERELAGVITRGGATNYAD SVKGRFTISRDNVKNTVYLQMNGLKPEDTAVYYCHGRSQLGSTWGQGTQVTVSS |
| 52 | DL61 | QVQLQESGGGLVQAGGSLRLSCLASGTIFTASTMGWHRQPPGKQRELVASIAGDGRTNYAE STEGRETISRDDAKNTMYLQMNSLKPEDTAVYYCYAYYLDTYAYWGQGTQVTVSS |
| 53 | DH1 | EVQLVESGGGLVQPGGSLTLSCAASGSIFSIASMGWYRQAPGKQRELVAVITSFSSTNYAD SVKGRFTISRDNAKNSVYLQMNSLRAEDTAVYYCNARYFERTDWGQGTLVTVSS |
| 54 | DH10 | EVQLVESGGGLVQPGGSLTLSCAASGRTSMFNSMGWHRQAPGKQRELVAIIRSGGSSNYAD TVKGRFTISRDNAKNSVYLQMNSLRAEDTAVYYCFYYFQSSYWGQGTLVTVSS |
| 55 | DH11 | EVQLVESGGGLVQPGGSLTLSCAASGSSVSFLSMAWYRQAPGKKRELVAGISVDGSTNYAD SVKGRFTISRDNAKNSVYLQMNSLRAEDTAVYYCYAYRWVGRDTYWGQGTLVTVSS |
| 56 | DH12 | EVQLVESGGGLVQPGGSLTLSCTASGSIFRGAAMYWHRQAPGKQRELVAAITTSGNTSYAD SVKGRFTISRDNAKNSMYLQMNSLRAEDTAVYYCAFWIAGKAYWGQGTLVTVSS |
| 57 | DH15 | EVQLVESGGGLVQPGGSLTLSCAASGSTFNIKTMAWHRQAPGNQRELVATLTSGGNTNYAD SVKGRFTISRDNAKNSVYLQMNSLRAEDTAVYYCGLWNGVGGAYWGQGTLVTVSS |
| 58 | DH17 | EVQLVESGGGLVQPGGSLTLSCAASGSTLNIKIMAWHRQAPGKQRELVATLTSGGNTNYAD SVKGRFTISRDNAKNSVYLQMNSLRAEDTAVYYCGLWDGVGGAYWGQGTLVTVSS |
| 59 | DH18 | EVQLVESGGGLVQPGGSLTLSCAASSSIFSISSMSWYRQAPGKQRELVAAITTFDYTNYAD SVKGRFTISRDNAKNSMYLQMNSLRAEDTAVYYCNARAFGRDYWGQGTLVTVSS |
| 60 | DH2 | EVQLVESGGGLVQPGGSLTLSCVASGSTSSINAMGWYRRAPGKQRELVAGISSDGSKNYAD SVKGRFTISRDNAKNSVYLQMNSLRAEDTAVYYCYYFRTVAASSMQYWGQGTLVTVSS |
| 61 | DH22 | EVQLVESGGGLVQPGGSLTLSCAASGFMFSSYSMSWYRQAPGKQRELVAAITSYGSTNYAD SVKGRFTISRDNAKNSVYLQMNSLRAEDTAVYYCNARSWNNYWGQGTLVTVSS |
| 62 | DH23 | EVQLVESGGGLVQPGGSLTLSCAASGSVSMFNSMGWHRQPPGKQRELVAIITSGGSSNYAD TVKGRFTISRDNAKNSVYLQMNSLRAEDTAVYYCFYYFQSSYWGQGTLVTVSS |
| 63 | DH27 | EVQLVESGGGLVQPGGSLTLSCTASGGRFSYATMGWSRQAPGKQREMVARITSSGFSTNYA DSVKGRFTISRDNAKNSVYLQMNSLRAEDTAVYYCNAQHFGTDSWGQGTLVTVSS |
| 64 | DH29 | EVQLVESGGGLVQPGGSLTLSCAASGSISSFNFMSWHRQAPGKERELAGVITRGGATNYAD SVKGRFTISRDNAKNSVYLQMNSLRAEDTAVYYCHGRSQLGSTWGQGTLVTVSS |
| 65 | DH3 | EVQLVESGGGLVQPGGSLTLSCAASESIFSINVMAWHRQAPGKQRELVARITSGGSTNYAD SVKGRFTISRDNAKNSVYLQMNSLRAEDTAVYYCGAYQGLYAYWGQGTLVTVSS |
| 66 | DH38 | EVQLVESGGGLVQPGGSLTLSCAASGSREISTMGWHRQAPGKQRELAARITSGGITKYADS VKGRFTISRDNAKNSVYLQMNSLRAEDTAVYYCFAYDNINAYWGQGTLVTVSS |
| 67 | DH42 | EVQLVESGGGLVQPGGSLTLSCTASGSIFSIAVMGWYRQVPGKRREWVATIFDGSYTNYAD SVKGRFTISRDNAKNSVYLQMNSLRAEDTAVYYCQTHWTQGSVPKESWGQGTLVTVSS |
| 68 | DH43 | EVQLVESGGGLVQPGGSLTLSCVASGSTSSINAMGWYRRAPGKQRELVAGISSDGSKVYAD SVKGRFTISRDNAKNSVYLQMNSLRAEDTAVYYCYYFRTVSGSSMRYWGQGTLVTVSS |
| 69 | DH45 | EVQLVESGGGLVQPGGSLTLSCVASSGIFSDMSMVWYRQAPGKQRELVASITTFGSTNYAD PVKGRFTISRDNAKNSVYLQMNSLRAEDTAVYYCSGRSYSSDYWGQGTLVTVSS |
| 70 | DH5 | EVQLVESGGGLVQPGGSLTLSCAASGFMFSSYSMSWYRQAPGKQRELVAAITTWGSTNYAD SVKGRFTISRDNAKNSVYLQMNSLRAEDTAVYYCNARSWNNYWGQGTLVTVSS |
| 71 | DH51 | EVQLVESGGGLVQPGGSLTLSCTASGSRFSYATMGWSRQAPGKQRELVARITSSGFSTNYA DSVKGRFTISRDNAKNSVYLQMNSLRAEDTAVYYCNAQQFGTDSWGQGTLVTVSS |
| 72 | DH54 | EVQLVESGGGLVQPGGSLTLSCAASGSTFTSNVMGWHRQAPGKQRELVANMHSGGSTNYAD SVKGRFTISRDNAKNSVYLQMNSLRAEDTAVYYCRWYGIQRAEGYWGQGTLVTVSS |
| 73 | DH56 | EVQLVESGGGLVQPGGSLTLSCAASGSSVSFLSMAWYRQAPGKKRELVAGISTDGSTNYVD SVKGRFTISRDNAKNSVYLQMNSLRAEDTAVYYCYAYRWVGRYTYWGQGTLVTVSS |

| | | -continued |
|---|---|---|
| 74 | DH58 | EVQLVESGGGLVQPGGSLTLSCVASGSISSIIVMGWSRQAPGKQRESVATITRDGTRNYAD SLKGRFTISRDNAKNSSYLQMNSLRAEDTAVYYCYARYGDINYWGQGTLVTVSS |
| 75 | DH6 | EVQLVESGGGLVQPGGSLTLSCAASGSSVSFLSMAWYRQAPGKKRELVAGISADGSTDYID SVKGRFTISRDNAKNSVYLQMNSLRAEDTAVYYCYAYRWTTRYTYWGQGTLVTVSS |
| 76 | DH61 | EVQLVESGGGLVQPGGSLTLSCLASGTIFTASTMGWHRQPPGKQRELVASIAGDGRTNYAE STEGRETISRDNAKNSMYLQMNSLRAEDTAVYYCYAYYLDTYAYWGQGTLVTVSS |
| 77 | DH67 | EVQLVESGGGLVQPGGSLTLSCAASGSSVSFLSMAWYRQAPGKKRELVAGISVDGSTNYAD SVKGRFTISRDNAKNSVYLQMNSLRAEDTAVYYCYARWEGRNTYWGQGTLVTVSS |
| 78 | DH69 | EVQLVESGGGLVQPGGSLTLSCVASGSSFSHNTMGWYRQAPGKQRDLVARITTFGTTNYAD SVKGRFTISRDNAKNSVYLQMNSLRAEDTAVYYCNGESFGRIWYNWGQGTLVTVSS |
| 79 | DH70 | EVQLVESGGGLVQPGGSLTLSCVASGSISSIIVMGWSRQAPGKQRESLATISRGGTRTYAD SVKGRFTISRDNAKNSSYLQMNSLRAEDTAVYYCYARYGDINYWGQGTLVTVSS |
| 80 | DH80 | EVQLVESGGGLVQPGGSLTLSCVASGSSFSITSMAWYRQAPGKQRDLVAAITSFGSTNYAD SVKDRFTISRDNAKNSVYLQMNSLRAEDTAVYYCNGRVFDHVYWGQGTLVTVSS |
| 81 | DH82 | EVQLVESGGGLVQPGGSLTLSCAASGRTSMVNSMGWHRQAPGKQRELVALITSGGSSNYAD TVKGRFTISRDNAKNSVYLQMNSLRAEDTAVYYCFYYFQSSYWGQGTLVTVSS |
| 82 | DH83 | EVQLVESGGGLVQPGGSLTLSCAASGSTFNFKIMAWHRQAPGKQRELVASLTSEGLTNYRD SVKGRFTISRDNAKNSVYLQMNSLRAEDTAVYYCGLWDGVGGAYWGQGTLVTVSS |
| 83 | DH84 | EVQLVESGGGLVQPGGSLTLSCAASGFTLDYYAIGWYRQAPGKKRELVAGISSDGSTHYVD SVKGRFTISRDNAKNSVYLQMNSLRAEDTAVYYCYAYRWVGGYTYWGQGTLVTVSS |
| 84 | DH89 | EVQLVESGGGLVQPGGSLTLSCVASGSIFTTNSMGWHRQPGKQRELVALIGSAGSTKYAD SVKGRFTISRDNAKNSVYLQMNSLRAEDTAVYYCFYYDSRSYWGQGTLVTVSS |
| 85 | DH92 | EVQLVESGGGLVQPGGSLTLSCAASGITSSVYSMGWYRQAPGKQRELVAGSSSDGSTHYVD SVRGRFTISRDNAKNSVYLQMNSLRAEDTAVYYCYANRGFAGAPSYWGQGTLVTVSS |
| 86 | DH94 | EVQLVESGGGLVQPGGSLTLSCAASSSIFSISSMSWYRQAPGKQRELVAAITSFGSTNYAD SVKGRFTISRDNAKNSMYLQMNSLRAEDTAVYYCNARTMGRDYWGQGTLVTVSS |
| 87 | 1A01 | EVQLVESGGGLVQPGGSLTLSCVASGFTSSINAMGWYRRAPGKQRELVAGISSDGSFVYAD SVKGRFTISRDNAKNSVYLQMNSLRAEDTAVYYCYYFRHVSGSSMRYWGQGTLVTVSS |
| 88 | 1A03 | EVQLVESGGGLVQPGGSLTLSCVASGSTSSINAMAWYRRAPGKQRELVAGISSDGSKVYAD SVKGRFTISRDNAKNSVYLQMNSLRAEDTAVYYCYYFRTVSGSSSRYWGQGTLVTVSS |
| 89 | 1A04 | EVQLVESGGGLVQPGGSLTLSCVASGSTSSINAMGWYRRAPGKQRELVAGISSDGSKVYED SVKGRFTISRDNAKNSVYLQMNSLRAEDTAVYYCYYFRTVSGSSMRYWGQGTLVTVSS |
| 90 | 1A05 | EVQLVESGGGLVQPGGSLTLSCVASGSPSSINAMGWYRRAPGKQRELSAGISSDGSKVYAD SVKGRFTISRDNAKNSVYLQMNSLRAEDTAVYYCYYFRTVRGSSMSYWGQGTLVTVSS |
| 91 | 1A06 | EVQLVESGGGLVQPGGSLTLSCVASGSTSSINAMGWYRRAPGKQRELAAGISSDGSSVYAD SVKGRFTISRDNAKNSVYLQMNSLRAEDTAVYYCYYFRTVSGSSKRYWGQGTLVTVSS |
| 92 | 1A07 | EVQLVESGGGLVQPGGSLTLSCVASGSISSINAMGWYRRAPGKQRELVAGISSDGSKVYAD SVKGRFTISRDNAKNSVYLQMNSLRAEDTAVYYCYYFRMVSGSSMRYWGQGTLVTVSS |
| 93 | 1A09 | EVQLVESGGGLVQPGGSLTLSCVASGSTSSINAMAWYRRAPGKQRELVAGISSDGSKLYAD SVKGRFTISRDNAKNSVYLQMNSLRAEDTAVYYCYYFRTVQGSSMRYWGQGTLVTVSS |
| 94 | 1A010 | EVQLVESGGGLVQPGGSLTLSCVASGSTSSINAYGWYRRAPGKQRELVAGISSDGSKVYAD SVKGRFTISRDNAKNSVYLQMNSLRAEDTAVYYCYYFRTVYGSSMRYWGQGTLVTVSS |
| 95 | 1A011 | EVQLVESGGGLVQPGGSLTLSCVASGSTSSINAIGWYRRAPGKQRELVAGISSDGSKVYID SVKGRFTISRDNAKNSVYLQMNSLRAEDTAVYYCYYFRTVSGSSRYWGQGTLVTVSS |
| 96 | 1A012 | EVQLVESGGGLVQPGGSLTLSCVASGSTSSINAMAWYRRAPGKQRELVAGISSDGSKVYSD SVKGRFTISRDNAKNSVYLQMNSLRAEDTAVYYCYYFRTVLGSSMRYWGQGTLVTVSS |
| 97 | 1B01 | EVQLVESGGGLVQPGGSLTLSCVASGSTSIINAMGWYRRAPGKQRELAAGISSDGSKVIAD SVKGRFTISRDNAKNSVYLQMNSLRAEDTAVYYCYYFRRVSGSSMRYWGQGTLVTVSS |
| 98 | 1B02 | EVQLVESGGGLVQPGGSLTLSCVASGSTSSINAMGWYRRAPGKQRELVAGISSDGSKIYAD SVKGRFTISRDNAKNSVYLQMNSLRAEDTAVYYCYYFRTVSGSSMRYWGQGTLVTVSS |
| 99 | 1B03 | EVQLVESGGGLVQPGGSLTLSCVASGKTSSINAMAWYRRAPGKQRELVAGISSDGSKVYTD SVKGRFTISRDNAKNSVYLQMNSLRAEDTAVYYCYYFRTVSGSSARYWGQGTLVTVSS |

| | | -continued |
|---|---|---|
| 100 | 1B04 | EVQLVESGGGLVQPGGSLTLSCVASGTTSSINAMGWYRRAPGKQRELVAGISSDGSLVYAD SVKGRFTISRDNAKNSVYLQMNSLRAEDTAVYYCYYFRIVRGSSMRYWGQGTLVTVSS |
| 101 | 1B05 | EVQLVESGGGLVQPGGSLTLSCVASGSTSSINAMAWYRRAPGKQRELVAGISSDGSKVYAD SVKGRFTISRDNAKNSVYLQMNSLRAEDTAVYYCYYYRTVSGSSMRYWGQGTLVTVSS |
| 102 | 1B07 | EVQLVESGGGLVQPGGSLTLSCVASGSGSSINAMGWYRRAPGKQRELVAGISSDGSKVYSD SVKGRFTISRDNAKNSVYLQMNSLRAEDTAVYYCYYFRHVSGSSMRYWGQGTLVTVSS |
| 103 | 1B08 | EVQLVESGGGLVQPGGSLTLSCVASGTTSSINAMGWYRRAPGKQRELVAGISSDGSKVYVD SVKGRFTISRDNAKNSVYLQMNSLRAEDTAVYYCYYFRFVSGSSMRYWGQGTLVTVSS |
| 104 | 1B09 | EVQLVESGGGLVQPGGSLTLSCVASGSTSSINAMAWYRRAPGKQRELVAGISSDGSKVYVD SVKGRFTISRDNAKNSVYLQMNSLRAEDTAVYYCYYFRTVSGSSMRYWGQGTLVTVSS |
| 105 | 1B010 | EVQLVESGGGLVQPGGSLTLSCVASGSTSRINAMGWYRRAPGKQRELVAGISSDGSKVYAD SVKGRFTISRDNAKNSVYLQMNSLRAEDTAVYYCYYFRTKSGSSMRYWGQGTLVTVSS |
| 106 | 1B011 | EVQLVESGGGLVQPGGSLTLSCVASGSTSRINAMGWYRRAPGKQRELVAGISSDGSKVYAD SVKGRFTISRDNAKNSVYLQMNSLRAEDTAVYYCYYFRTVYGSSMRYWGQGTLVTVSS |
| 107 | 1C01 | EVQLVESGGGLVQPGGSLTLSCVASGSTSSINAMGWYRRAPGKQRELVAGISSDGSKVYRD SVKGRFTISRDNAKNSVYLQMNSLRAEDTAVYYCYYFRTVSGSSMGYWGQGTLVTVSS |
| 108 | 1C02 | EVQLVESGGGLVQPGGSLTLSCVASGSTSSINAMAWYRRAPGKQRELVAGISSDGSKVYSD SVKGRFTISRDNAKNSVYLQMNSLRAEDTAVYYCYYFRTVSGSSMRSWGQGTLVTVSS |
| 109 | 1C03 | EVQLVESGGGLVQPGGSLTLSCVASGSTSSINAMAWYRRAPGKQRELVAGISSDNSKVYAD SVKGRFTISRDNAKNSVYLQMNSLRAEDTAVYYCYYFRTVGGSSMRYWGQGTLVTVSS |
| 110 | 1C04 | EVQLVESGGGLVQPGGSLTLSCVASGNTSSINAMAWYRRAPGKQRELVAGISSDGSKVYAD SVKGRFTISRDNAKNSVYLQMNSLRAEDTAVYYCYYFRTVSGSSMRYWGQGTLVTVSS |
| 111 | 1C05 | EVQLVESGGGLVQPGGSLTLSCVASGSTSSINAMAWYRRAPGKQRELVAGISSDGSKVYAD SVKGRFTISRDNAKNSVYLQMNSLRAEDTAVYYCYYFRTVSGSHMRYWGQGTLVTVSS |
| 112 | 1C06 | EVQLVESGGGLVQPGGSLTLSCVASGSTSIINAMGWYRRAPGKQRELVAGISSDGSKVYED SVKGRFTISRDNAKNSVYLQMNSLRAEDTAVYYCYYFRAVSGSSMRYWGQGTLVTVSS |
| 113 | 1C07 | EVQLVESGGGLVQPGGSLTLSCVASGSTSSINAMAWYRRAPGKQRELVAGISSDGSKVYAD SVKGRFTISRDNAKNSVYLQMNSLRAEDTAVYYCYYFRTVSGSSMRYWGQGTLVTVSS |
| 114 | 1C08 | EVQLVESGGGLVQPGGSLTLSCVASGSTSRINAMGWYRRAPGKQRELPAGISSDGSKVYAV SVKGRFTISRDNAKNSVYLQMNSLRAEDTAVYYCYYFRTVSGSPMRYWGQGTLVTVSS |
| 115 | 1C010 | EVQLVESGGGLVQPGGSLTLSCVASGSTSRINAMGWYRRAPGKQRELVAGVSSDGSKVYAD SVKGRFTISRDNAKNSVYLQMNSLRAEDTAVYYCYYFRTVSGSSMSYWGQGTLVTVSS |
| 116 | 1C011 | EVQLVESGGGLVQPGGSLTLSCVASGTTSSINAMGWYRRAPGKQRELVAGISSDGSKVYED SVKGRFTISRDNAKNSVYLQMNSLRAEDTAVYYCYYFRTVSGSSMRYWGQGTLVTVSS |
| 117 | 1C012 | EVQLVESGGGLVQPGGSLTLSCVASGITSSINAMGWYRRAPGKQRELVAGISSDGSKVYAG SVKGRFTISRDNAKNSVYLQMNSLRAEDTAVYYCYYFRTVRGSSMRYWGQGTLVTVSS |
| 118 | 1D01 | EVQLVESGGGLVQPGGSLTLSCVASGSTSDINAMGWYRRAPGKQRELVAGISSDKSKVYAD SVKGRFTISRDNAKNSVYLQMNSLRAEDTAVYYCYYFRTVRGSSMRYWGQGTLVTVSS |
| 119 | 1D02 | EVQLVESGGGLVQPGGSLTLSCVASGSTSSINAMAWYRRAPGKQRELVAGISSNGSKVYAD SVKGRFTISRDNAKNSVYLQMNSLRAEDTAVYYCYYFRQVSGSSMRYWGQGTLVTVSS |
| 120 | 1D03 | EVQLVESGGGLVQPGGSLTLSCVASGSTSSINAIGWYRRAPGKQRELVAGISSDGSKVLAD SVKGRFTISRDNAKNSVYLQMNSLRAEDTAVYYCYYFRIVSGSSMGYWGQGTLVTVSS |
| 121 | 1D04 | EVQLVESGGGLVQPGGSLTLSCVASGSTSSKNAMGWYRRAPGKQRELVAGISSDGSKVYAD SVKGRFTISRDNAKNSVYLQMNSLRAEDTAVYYCYYFRTVSGASMRYWGQGTLVTVSS |
| 122 | 1D06 | EVQLVESGGGLVQPGGSLTLSCVASGSTSSINAMGWYRRAPGKQRELVAGISSDNSKVYAD SVKGRFTISRDNAKNSVYLQMNSLRAEDTAVYYCYYFRTVHGSSMRYWGQGTLVTVSS |
| 123 | 1D08 | EVQLVESGGGLVQPGGSLTLSCVASGLTSSINAMGWYRRAPGKQRELVAGISSDGSKVYAD SVKGRFTISRDNAKNSVYLQMNSLRAEDTAVYYCYYFRMVSGSSMRYWGQGTLVTVSS |
| 124 | 1D09 | EVQLVESGGGLVQPGGSLTLSCVASGSTSSINAMAWYRRAPGKQRELVAGISSDGSKVYTD SVKGRFTISRDNAKNSVYLQMNSLRAEDTAVYYCYYFRTISGSSMRYWGQGTLVTVSS |
| 125 | 1D010 | EVQLVESGGGLVQPGGSLTLSCVASGSTSSNNAMAWYRRAPGKQRELVAGISSDGSKVYTD SVKGRFTISRDNAKNSVYLQMNSLRAEDTAVYYCYYFRTRSGSSMRYWGQGTLVTVSS |

-continued

| 126 | 1D011 | EVQLVESGGGLVQPGGSLTLSCVASGSTSSINAMAWYRRAPGKQRELVAGISSDNSKVYAD<br>SVKGRFTISRDNAKNSVYLQMNSLRAEDTAVYYCYYFRTVSGHSMRYWGQGTLVTVSS |
| --- | --- | --- |
| 127 | 1D012 | EVQLVESGGGLVQPGGSLTLSCVASGSTSHINAMGWYRRAPGKQRELVAGISSDGSRVYAD<br>SVKGRFTISRDNAKNSVYLQMNSLRAEDTAVYYCYYFRTVSGGSMRYWGQGTLVTVSS |
| 128 | 1E02 | EVQLVESGGGLVQPGGSLTLSCVASGQTSSINAMGWYRRAPGKQRELVAGISSDGSQVYAD<br>SVKGRFTISRDNAKNSVYLQMNSLRAEDTAVYYCYYFRTKSGSSMRYWGQGTLVTVSS |
| 129 | 1E04 | EVQLVESGGGLVQPGGSLTLSCVASGSTSRINGMGWYRRAPGKQRELPAGISSDGSKAYAD<br>SVKGRFTISRDNAKNSVYLQMNSLRAEDTAVYYCYYFRTASGTSMRYWGQGTLVTVSS |
| 130 | 1E05 | EVQLVESGGGLVQPGGSLTLSCVASGSTSVINAMAWYRRAPGKQRELAAGISSDGSKVYAK<br>SAKGRFTISRDNAKNSVYLQMNSLRAEDTAVYYCYYFNTVSGSSMRYWGQGTLVTVSS |
| 131 | 1E07 | EVQLVESGGGLVQPGGSLTLSCVASGSTSSINAMAWYRRAPGKQRELVAGISSDGSKVYND<br>SVKGRFTISRDNAKNSVYLQMNSLRAEDTAVYYCYYFRTVRGSSQRYWGQGTLVTVSS |
| 132 | 1E08 | EVQLVESGGGLVQPGGSLTLSCVASGKTSSINAMGWYRRAPGKQRELVAGISSDGSKVIAD<br>SVKGRFTISRDNAKNSVYLQMNSLRAEDTAVYYCYYFRTVLGSSMRYWGQGTLVTVSS |
| 133 | 1E09 | EVQLVESGGGLVQPGGSLTLSCVASGSTSSINAMAWYRRAPGKQRELVAGISSDGSKVYTD<br>SVKGRFTISRDNAKNSVYLQMNSLRAEDTAVYYCYYFRTRSGSSMRYWGQGTLVTVSS |
| 134 | 1E010 | EVQLVESGGGLVQPGGSLTLSCVASGSVSSINAMGWYRRAPGKQRELVAGISSDGSKVYID<br>SVKGRFTISRDNAKNSVYLQMNSLRAEDTAVYYCYYFRTVSGLSMRYWGQGTLVTVSS |
| 135 | 1E011 | EVQLVESGGGLVQPGGSLTLSCVASGNTSSINAMGWYRRAPGKQRELVAGISSDGSKVYYD<br>SVKGRFTISRDNAKNSVYLQMNSLRAEDTAVYYCYYFRTVRGSSQRYWGQGTLVTVSS |
| 136 | 1E012 | EVQLVESGGGLVQPGGSLTLSCVASGSTSSTNAMGWYRRAPGKQRELVAGISSDGSKVYVD<br>SVKGRFTISRDNAKNSVYLQMNSLRAEDTAVYYCYYFRTVSGSSMVYWGQGTLVTVSS |
| 137 | 1F01 | EVQLVESGGGLVQPGGSLTLSCVASGSTSSINAMGWYRRAPGKQRELVAGISSDGSKVYGD<br>SVKGRFTISRDNAKNSVYLQMNSLRAEDTAVYYCYYFRTVSRSSMRYWGQGTLVTVSS |
| 138 | 1F02 | EVQLVESGGGLVQPGGSLTLSCVASGSTSSINAMAWYRRAPGKQRELAAGISSDQSKVYAD<br>SAKGRFTISRDNAKNSVYLQMNSLRAEDTAVYYCYYFRTVSGSSMSYWGQGTLVTVSS |
| 139 | 1F04 | EVQLVESGGGLVQPGGSLTLSCVASGGTSSINAMGWYRRAPGKQRELVAGISSDGSKVYSD<br>SVKGRFTISRDNAKNSVYLQMNSLRAEDTAVYYCYYFRTVSGSSARYWGQGTLVTVSS |
| 140 | 1F05 | EVQLVESGGGLVQPGGSLTLSCVASGSTRSINAMGWYRRAPGKQRELVAGISSDGSKVYAD<br>SVKGRFTISRDNAKNSVYLQMNSLRAEDTAVYYCYYFHTVSGSSMRYWGQGTLVTVSS |
| 141 | 1F06 | EVQLVESGGGLVQPGGSLTLSCVASGTTSSINAMGWYRRAPGKQRELVAGISSDGSKVIAD<br>SVKGRFTISRDNAKNSVYLQMNSLRAEDTAVYYCYYFRTVLGSSMRYWGQGTLVTVSS |
| 142 | 1F07 | EVQLVESGGGLVQPGGSLTLSCVASGSTSSINAMGWYRRAPGKQRELVAGISSDGSKVDAD<br>SVKGRFTISRDNAKNSVYLQMNSLRAEDTAVYYCYYFRTVSGSSMRYWGQGTLVTVSS |
| 143 | 1F08 | EVQLVESGGGLVQPGGSLTLSCVASGSTSSINAMAWYRRAPGKQRELVAGISSDGSKVYKD<br>SVKGRFTISRDNAKNSVYLQMNSLRAEDTAVYYCYYFRNVSGSSMRYWGQGTLVTVSS |
| 144 | 1F09 | EVQLVESGGGLVQPGGSLTLSCVASGNTSSINAMGWYRRAPGKQRELVAGISSNGSKVYAD<br>SVKGRFTISRDNAKNSVYLQMNSLRAEDTAVYYCYYFRTVTGSSMRYWGQGTLVTVSS |
| 145 | 1F010 | EVQLVESGGGLVQPGGSLTLSCVASGSTSRINAMGWYRRAPGKQRELVAGISSDGSKVYKD<br>SVKGRFTISRDNAKNSVYLQMNSLRAEDTAVYYCYYFRTVSGSSMRYWGQGTLVTVSS |
| 146 | 1F011 | EVQLVESGGGLVQPGGSLTLSCVASGSTSSINAIGWYRRAPGKQRELVAGISSDGSKVYAD<br>SVKGRFTISRDNAKNSVYLQMNSLRAEDTAVYYCYYFRTVKGSSMRYWGQGTLVTVSS |
| 147 | 1F012 | EVQLVESGGGLVQPGGSLTLSCVASGLTSSINAMGWYRRAPGKQRELVAGISSDGSKVYQD<br>SVKGRFTISRDNAKNSVYLQMNSLRAEDTAVYYCYYFRTNSGSSMRYWGQGTLVTVSS |
| 148 | 1G01 | EVQLVESGGGLVQPGGSLTLSCVASGSTSSINAMAWYRRAPGKQRELVAGISSDGSKVYAE<br>SVKGRFTISRDNAKNSVYLQMNSLRAEDTAVYYCYYFRTVSGASMRYWGQGTLVTVSS |
| 149 | 1G04 | EVQLVESGGGLVQPGGSLTLSCVASGSTSSTNAMGWYRRAPGKQRELVAGISSDGSKVLAD<br>SVKGRFTISRDNAKNSVYLQMNSLRAEDTAVYYCYYFRTVNLSSMRYWGQGTLVTVSS |
| 150 | 1G05 | EVQLVESGGGLVQPGGSLTLSCVASGSTSSINAIGWYRRAPGKQRELVAGISSDGSKYYAD<br>SVKGRFTISRDNAKNSVYLQMNSLRAEDTAVYYCYYFRTVTGSSMRYWGQGTLVTVSS |
| 151 | 1G06 | EVQLVESGGGLVQPGGSLTLSCVASGSTSSINAIGWYRRAPGKQRELVAGISSDGSKVYAV<br>SVKGRFTISRDNAKNSVYLQMNSLRAEDTAVYYCYYFRKVSGSSARYWGQGTLVTVSS |

-continued

| 152 | 1G07 | EVQLVESGGGLVQPGGSLTLSCVASGSTSSINAMGWYRRAPGKQRELVAGISSDGSKVVAD SVKGRFTISRDNAKNSVYLQMNSLRAEDTAVYYCYYFRTYSGSSMRYWGQGTLVTVSS |
|---|---|---|
| 153 | 1G09 | EVQLVESGGGLVQPGGSLTLSCVASGSTSSINAMGWYRRAPGKQRELVAGISSDGSKVYAD SVKGRFTISRDNAKNSVYLQMNSLRAEDTAVYYCYYFRTVSKSSMRYWGQGTLVTVSS |
| 154 | 1G011 | EVQLVESGGGLVQPGGSLTLSCVASGSTSSINAMAWYRRAPGKQRELVAGISSDGSKVYAD SVKGRFTISRDNAKNSVYLQMNSLRAEDTAVYYCYYFKTVSGSSMRYWGQGTLVTVSS |
| 155 | 1H01 | EVQLVESGGGLVQPGGSLTLSCVASGSTSSINAMAWYRRAPGKQRELAAGISSDNSKVYAD SVKGRFTISRDNAKNSVYLQMNSLRAEDTAVYYCYYFRTRSGSSMRYWGQGTLVTVSS |
| 156 | 1H02 | EVQLVESGGGLVQPGGSLTLSCVASGSKSSINAMGWYRRAPGKQRELAAGISSDGSKVYAQ SVKGRFTISRDNAKNSVYLQMNSLRAEDTAVYYCYYFRTSSGSSMRYWGQGTLVTVSS |
| 157 | 1H06 | EVQLVESGGGLVQPGGSLTLSCVASGTTSSINAMGWYRRAPGKQRELVAGISSDGSKVYVD SVKGRFTISRDNAKNSVYLQMNSLRAEDTAVYYCYYFRFLSGSSMRYWGQGTLVTVSS |
| 158 | 1H07 | EVQLVESGGGLVQPGGSLTLSCVASGSTSSINAFGWYRRAPGKQRELVAGISSDGSKVYSD SVKGRFTISRDNAKNSVYLQMNSLRAEDTAVYYCYYFRTSGSSMRYWGQGTLVTVSS |
| 159 | 1H08 | EVQLVESGGGLVQPGGSLTLSCVASGSTFSINAMGWYRRAPGKQRELVAGISSDGSKVLAD SVKGRFTISRDNAKNSVYLQMNSLRAEDTAVYYCYYFRLVSGSSMRYWGQGTLVTVSS |
| 160 | 1H010 | EVQLVESGGGLVQPGGSLTLSCVASGSTRSINAMGWYRRAPGKQRELVAGISSDGSKVYND SVKGRFTISRDNAKNSVYLQMNSLRAEDTAVYYCYYFRTVSGSSMRFWGQGTLVTVSS |
| 161 | 1H011 | EVQLVESGGGLVQPGGSLTLSCVASGSTSSINAIGWYRRAPGKQRELVAGISSDGSKVYND SVKGRFTISRDNAKNSVYLQMNSLRAEDTAVYYCYYFRTQSGSSMRYWGQGTLVTVSS |
| 162 | 1H012 | EVQLVESGGGLVQPGGSLTLSCVASGSTSSINAMGWYRRAPGKQRELVAGISSDGSKVYVD SVKGRFTISRDNAKNSVYLQMNSLRAEDTAVYYCYYFRTVSGSSMPYWGQGTLVTVSS |
| 163 | 2A01 | EVQLVESGGGLVQPGGSLTLSCVASGSTSSINAMGWYRRAPGKQRELVAGISSDGSKVVAD SVKGRFTISRDNAKNSVYLQMNSLRAEDTAVYYCYYFRTLSGSSMRYWGQGTLVTVSS |
| 164 | 2A03 | EVQLVESGGGLVQPGGSLTLSCVASGTTSSINAMGWYRRAPGKQRELVAGISSDGSKVYGD SVKGRFTISRDNAKNSVYLQMNSLRAEDTAVYYCYYFRTVSGSAMRYWGQGTLVTVSS |
| 165 | 2A04 | EVQLVESGGGLVQPGGSLTLSCVASGSTSSINAMAWYRRAPGKQRELVAGISSDGSKVYTD SVKGRFTISRDNAKNSVYLQMNSLRAEDTAVYYCYYFRTTSGSSMRYWGQGTLVTVSS |
| 166 | 2A05 | EVQLVESGGGLVQPGGSLTLSCVASGRTSSINAMGWYRRAPGKQRELVAGISSDGSKVYND SVKGRFTISRDNAKNSVYLQMNSLRAEDTAVYYCYYFRTVSGTSMRYWGQGTLVTVSS |
| 167 | 2A06 | EVQLVESGGGLVQPGGSLTLSCVASGSTSSRNAMGWYRRAPGKQRELVAGISSDGSKVTAD SVKGRFTISRDNAKNSVYLQMNSLRAEDTAVYYCYYFRTRSGSSMRYWGQGTLVTVSS |
| 168 | 2A08 | EVQLVESGGGLVQPGGSLTLSCVASGSTKSINAMGWYRRAPGKQRELVAGISSDGSKVYRD SVKGRFTISRDNAKNSVYLQMNSLRAEDTAVYYCYYFRTSSGSSMRYWGQGTLVTVSS |
| 169 | 2A09 | EVQLVESGGGLVQPGGSLTLSCVASGSTSSRNAMGWYRRAPGKQRELVAGISSNGSKVYSD SVKGRFTISRDNAKNSVYLQMNSLRAEDTAVYYCYYFRTVSGSSMSYWGQGTLVTVSS |
| 170 | 2A011 | EVQLVESGGGLVQPGGSLTLSCVASGSTSSINAIGWYRRAPGKQRELVAGISSDGSKVYSD SVKGRFTISRDNAKNSVYLQMNSLRAEDTAVYYCYYFRPVSGSSMRYWGQGTLVTVSS |
| 171 | 2B01 | EVQLVESGGGLVQPGGSLTLSCVASGSTSLINAMGWYRRAPGKQRELVAGISSDGSKVYAD SVKGRFTISRDNAKNSVYLQMNSLRAEDTAVYYCYYFRHVSGSSMRYWGQGTLVTVSS |
| 172 | 2B02 | EVQLVESGGGLVQPGGSLTLSCVASGSTSSINAMAWYRRAPGKQRELVAGISSDGSKVYAD SVKGRFTISRDNAKNSVYLQMNSLRAEDTAVYYCYYFRTKSGSSMRYWGQGTLVTVSS |
| 173 | 2B03 | EVQLVESGGGLVQPGGSLTLSCVASGSTSSINAMGWYRRAPGKQRELVAGISSDGSLVYAD SVKGRFTISRDNAKNSVYLQMNSLRAEDTAVYYCYYFTTVSGSSMRYWGQGTLVTVSS |
| 174 | 2B05 | EVQLVESGGGLVQPGGSLTLSCVASGTTSSINAMGWYRRAPGKQRELVAGISSDGTKVYAD SVKGRFTISRDNAKNSVYLQMNSLRAEDTAVYYCYYFHTVSGSSMRYWGQGTLVTVSS |
| 175 | 2B07 | EVQLVESGGGLVQPGGSLTLSCVASGSTSSINAFGWYRRAPGKQRELVAGISSDGSKVYAD SVKGRFTISRDNAKNSVYLQMNSLRAEDTAVYYCYYFRTVRGSSMRYWGQGTLVTVSS |
| 176 | 2B010 | EVQLVESGGGLVQPGGSLTLSCVASGSTSSRNAMGWYRRAPGKQRELVAGISSDGSKLYLD SVKGRFTISRDNAKNSVYLQMNSLRAEDTAVYYCYYFRTVLGSSMRYWGQGTLVTVSS |
| 177 | 2B011 | EVQLVESGGGLVQPGGSLTLSCVASGNTSSINAMGWYRRAPGKQRELVAGISSDGSRVYAD SVKGRFTISRDNAKNSVYLQMNSLRAEDTAVYYCYYFRTVSGSSMRSWGQGTLVTVSS |

| | | |
|---|---|---|
| 178 | 2B012 | EVQLVESGGGLVQPGGSLTLSCVASGTTSSINAMGWYRRAPGKQRELVAGISSDGSKVYND SVKGRFTISRDNAKNSVYLQMNSLRAEDTAVYYCYYFRTVRGSSMRYWGQGTLVTVSS |
| 179 | 2C01 | EVQLVESGGGLVQPGGSLTLSCVASGSTASINAMGWYRRAPGKQRELVAGISSDGSKVYAD SVKGRFTISRDNAKNSVYLQMNSLRAEDTAVYYCYYFRYVSGSSMRYWGQGTLVTVSS |
| 180 | 2C02 | EVQLVESGGGLVQPGGSLTLSCVASGSTSSINAVGWYRRAPGKQRELVAGISSDGSKVYVD SVKGRFTISRDNAKNSVYLQMNSLRAEDTAVYYCYYFRTVYGSSMRYWGQGTLVTVSS |
| 181 | 2C04 | EVQLVESGGGLVQPGGSLTLSCVASGSTSSRNAMGWYRRAPGKQRELVAGISSDGSKLYAD SVKGRFTISRDNAKNSVYLQMNSLRAEDTAVYYCYYFRTVLGSSMRYWGQGTLVTVSS |
| 182 | 2C06 | EVQLVESGGGLVQPGGSLTLSCVASGSTNSINAMGWYRRAPGKQRELVAGISSDGSKVYKD SVKGRFTISRDNAKNSVYLQMNSLRAEDTAVYYCYYRTVSGSSMRYWGQGTLVTVSS |
| 183 | 2C07 | EVQLVESGGGLVQPGGSLTLSCVASGSTSSINAMAWYRRAPGKQRELVAGISSDGSKVYAD SVKGRFTISRDNAKNSVYLQMNSLRAEDTAVYYCYYFRSVSGSSMRYWGQGTLVTVSS |
| 184 | 2C08 | EVQLVESGGGLVQPGGSLTLSCVASGSTSRINAMGWYRRAPGKQRELVAGISSDGSKVYQD SVKGRFTISRDNAKNSVYLQMNSLRAEDTAVYYCYYFRRVSGSSMRYWGQGTLVTVSS |
| 185 | 2C09 | EVQLVESGGGLVQPGGSLTLSCVPSGSTSNINAMGWYRRAPGKQRELPAGISSDGTKIYAD SAKVPFTITRDNAKNSVYLQMNSLRAEDTAVYYCYYFRTVSGTSMRYWGQGTLVTVSS |
| 186 | 2C010 | EVQLVESGGGLVQPGGSLTLSCVASGSTSKINAMGWYRRAPGKQRELVAGISSDRSKVYAD SVKGRFTISRDNAKNSVYLQMNSLRAEDTAVYYCYYFRTVAGSSMRYWGQGTLVTVSS |
| 187 | 2D02 | EVQLVESGGGLVQPGGSLTLSCVASGSTSSINALGWYRRAPGKQRELVAGISSDGSLVYAD SVKGRFTISRDNAKNSVYLQMNSLRAEDTAVYYCYYFRIVSGSSMRYWGQGTLVTVSS |
| 188 | 2D03 | EVQLVESGGGLVQPGGSLTLSCVASGKTSSINAMGWYRRAPGKQRELVAGISSDGSKVYAD SVKGRFTISRDNAKNSVYLQMNSLRAEDTAVYYCYYFRTVSGVSMRYWGQGTLVTVSS |
| 189 | 2D04 | EVQLVESGGGLVQPGGSLTLSCVASGSTSSINAVGWYRRAPGKQRELVAGISSDGSKVYRD SVKGRFTISRDNAKNSVYLQMNSLRAEDTAVYYCYYFRTVQGSSMRYWGQGTLVTVSS |
| 190 | 2D05 | EVQLVESGGGLVQPGGSLTLSCVASGSTSRINAMGWYRRAPGKQRELVAGISSDGSKVYAD SVKGRFTISRDNAKNSVYLQMNSLRAEDTAVYYCYYFRTASGSSMRYWGQGTLVTVSS |
| 191 | 2D06 | EVQLVESGGGLVQPGGSLTLSCVASGSTSSINAMGWYRRAPGKQRELVAGISSDGSKVYSD SVKGRFTISRDNAKNSVYLQMNSLRAEDTAVYYCYYFRTVSGSSSRYWGQGTLVTVSS |
| 192 | 2D07 | EVQLVESGGGLVQPGGSLTLSCVASGSTSSINAVGWYRRAPGKQRELVAGISSDGTKVYRD SVKGRFTISRDNAKNSVYLQMNSLRAEDTAVYYCYYFRTVQGSSMRYWGQGTLVTVSS |
| 193 | 2D09 | EVQLVESGGGLVQPGGSLTLSCVASGTTSSINAMGWYRRAPGKQRELAAGISSDGSKVYND SVKGRFTISRDNAKNSVYLQMNSLRAEDTAVYYCYYFRTVRGSSMRYWGQGTLVTVSS |
| 194 | 2D010 | EVQLVESGGGLVQPGGSLTLSCVASGSTSSINAMGWYRRAPGKQRELVAGISSDGSKVYAD SVKGRFTISRDNAKNSVYLQMNSLRAEDTAVYYCYYFRTKSGSSMRYWGQGTLVTVSS |
| 195 | 2D011 | EVQLVESGGGLVQPGGSLTLSCVASGTTSSINAMGWYRRAPGKQRELVAGISSDGSKVYAD SVKGRFTISRDNAKNSVYLQMNSLRAEDTAVYYCYYFRTVWGSSMRYWGQGTLVTVSS |
| 196 | 2D012 | EVQLVESGGGLVQPGGSLTLSCVASGKTSSINAMGWYRRAPGKQRELVAGISSDGSKVYTD SVKGRFTISRDNAKNSVYLQMNSLRAEDTAVYYCYYFRTRSGSSMRYWGQGTLVTVSS |
| 197 | 2E01 | EVQLVESGGGLVQPGGSLTLSCVASGSTSSINAMGWYRRAPFKQGELPAGISPDGTKAYAD SAKVRFTISRDNAKNSVYLQMNSLRAEDTAVYYCYYFHTVCGTSMGYWGQGTLVTVSS |
| 198 | 2E02 | EVQLVESGGGLVQPGGSLTLSCVASGSTSAINAMGWYRRAPGKQRELVAGISSDGSKVYVD SVKGRFTISRDNAKNSVYLQMNSLRAEDTAVYYCYYFRTVSGSSQRYWGQGTLVTVSS |
| 199 | 2E05 | EVQLVESGGGLVQPGGSLTLSCVASGSPSSINAYGWYRRAPGKQRELVAGISSDGSKVYSD SVKGRFTISRDNAKNSVYLQMNSLRAEDTAVYYCYYFRTVSGSSMSYWGQGTLVTVSS |
| 200 | 2E06 | EVQLVESGGGLVQPGGSLTLSCVASGSTSSINAMGWYRRAPGKQRELVAGISSDGSKVYAS SVKGRFTISRDNAKNSVYLQMNSLRAEDTAVYYCYYFRTVRGSSMRYWGQGTLVTVSS |
| 201 | 2E08 | EVQLVESGGGLVQPGGSLTLSCVASGSRSSINAMGWYRRAPGKQRELVAGISADGSKVYAD SVKGRFTISRDNAKNSVYLQMNSLRAEDTAVYYCYYFRTQSGSSMRYWGQGTLVTVSS |
| 202 | 2E09 | EVQLVESGGGLVQPGGSLTLSCVASGSVSSINAMGWYRRAPGKQRELVAGISSDGSKVYAS SAKGRFTISRDNAKNSVYLQMNSLRAEDTAVYYCYYFRTLSGSSMRYWGQGTLVTVSS |
| 203 | 2E010 | EVQLVESGGGLVQPGGSLTLSCVASGSTSSINAMAWYRRAPGKQRELVAGISSDGSKVYAD SVKGRFTISRDNAKNSVYLQMNSLRAEDTAVYYCYYFHTVSGSSMRYWGQGTLVTVSS |

| | | -continued |
|---|---|---|
| 204 | 2E011 | EVQLVESGGGLVQPGGSLTLSCVASGSTSSINAIGWYRRAPGKQRELVAGISSDGSSVYAD<br>SVKGRFTISRDNAKNSVYLQMNSLRAEDTAVYYCYYFRRVSGSSMRYWGQGTLVTVSS |
| 205 | 2F01 | EVQLVESGGGLVQPGGSLTLSCVASGSTSSINAMGWYRRAPGKQRELVAGISSDGSKVYSD<br>SVKGRFTISRDNAKNSVYLQMNSLRAEDTAVYYCYYFRLVSGSSMRYWGQGTLVTVSS |
| 206 | 2F02 | EVQLVESGGGLVQPGGSLTLSCVASGSTSSINAVGWYRRAPGKQRELVAGISSDGSKVYAG<br>SVKGRFTISRDNAKNSVYLQMNSLRAEDTAVYYCYYFRTVSGSYMRYWGQGTLVTVSS |
| 207 | 2F03 | EVQLVESGGGLVQPGGSLTLSCVASGSTSSINAMAWYRRAPGKQRELAAGISSDNSKVYAD<br>SVKGRFTISRDNAKNSVYLQMNSLRAEDTAVYYCYYFRTVGGSSMRYWGQGTLVTVSS |
| 208 | 2F06 | EVQLVESGGGLVQPGGSLTLSCVASGSTSSINAYGWYRRAPGKQRELVAGISSDGSAVYAD<br>SVKGRFTISRDNAKNSVYLQMNSLRAEDTAVYYCYYFRTHSGSSMRYWGQGTLVTVSS |
| 209 | 2F07 | EVQLVESGGGLVQPGGSLTLSCVASGSTSSINAVGWYRRAPGKQRELVAGISSDGSSVYAD<br>SVKGRFTISRDNAKNSVYLQMNSLRAEDTAVYYCYYFRTVSTSSMRYWGQGTLVTVSS |
| 210 | 2F08 | EVQLVESGGGLVQPGGSLTLSCVASGSKSSINAMGWYRRAPGKQRELPAGISSNGTKVYAD<br>SAKVRFTISRDNAKNSVYLQMNSLRAEDTAVYYCYYFRTVLGTSMRYWGQGTLVTVSS |
| 211 | 2F09 | EVQLVESGGGLVQPGGSLTLSCVASGSTSSINAMAWYRRAPGKQRELVAGISSDGSKLYAD<br>SVKGRFTISRDNAKNSVYLQMNSLRAEDTAVYYCYYFRTVSGSSMRYWGQGTLVTVSS |
| 212 | 2F11 | EVQLVESGGGLVQPGGSLTLSCVASGSVSSINAMGWYRRAPGKQRELVAGISSDGSKVYKD<br>SVKGRFTISRDNAKNSVYLQMNSLRAEDTAVYYCYYFRTVSGSMGYWGQGTLVTVSS |
| 213 | 2G03 | EVQLVESGGGLVQPGGSLTLSCVASGSTSSINAMGWYRRAPGKQRELVAGISSDGSLVYAD<br>SVKGRFTISRDNAKNSVYLQMNSLRAEDTAVYYCYYFRTVSGSSMRAWGQGTLVTVSS |
| 214 | 2G04 | EVQLVESGGGLVQPGGSLTLSCVASGSTSSINAMGWYRRAPGKQRELVAGISSDGSLVYAD<br>SVKGRFTISRDNAKNSVYLQMNSLRAEDTAVYYCYYFRILSGSSMRYWGQGTLVTVSS |
| 215 | 2G07 | EVQLVESGGGLVQPGGSLTLSCVASGSTSSINAMAWYRRAPGKQRELVAGISSDGSKVYAD<br>SVKGRFTISRDNAKNSVYLQMNSLRAEDTAVYYCYYFRTVQGSSMRYWGQGTLVTVSS |
| 216 | 2G08 | EVQLVESGGGLVQPGGSLTLSCVASGSTSYINAMGWYRRAPGKQRELVAGISSDGSKVYAD<br>SVKGRFTISRDNAKNSVYLQMNSLRAEDTAVYYCYYFRTVSGQSMGYWGQGTLVTVSS |
| 217 | 2G09 | EVQLVESGGGLVQPGGSLTLSCVASGSTSSINAMGWYRRAPGKQRELVAGVSSDGSKVYAD<br>SVKGRFTISRDNAKNSVYLQMNSLRAEDTAVYYCYYFRTVSGSSARYWGQGTLVTVSS |
| 218 | 2G011 | EVQLVESGGGLVQPGGSLTLSCVASGSTSSINAMGWYRRAPGKQRELPAGISRDGSKVYAD<br>SVKGRFTISRDNAKNSVYLQMNSLRAEDTAVYYCYYFRYVSGSSMRYWGQGTLVTVSS |
| 219 | 2H010 | EVQLVESGGGLVQPGGSLTLSCVASGSTSSINAMGWYRRAPGKQRELAAGISSDGSKLYAD<br>SVKGRFTISRDNAKNSVYLQMNSLRAEDTAVYYCYYFRTVSGSSMRYWGQGTLVTVSS |
| 220 | 2H011 | EVQLVESGGGLVQPGGSLTLSCVASGSTSRINAMGWYRRAPGKQRELVAGISSDGSKVYAD<br>SVKGRFTISRDNAKNSVYLQMNSLRAEDTAVYYCYYFRRVSGSSMRYWGQGTLVTVSS |
| 221 | 2H02 | EVQLVESGGGLVQPGGSLTLSCVASGSTSSINAMAWYRRAPGKQRELAAGISSDGSKVYAD<br>SVKGRFTISRDNAKNSVYLQMNSLRAEDTAVYYCYYFHTVSGSSMRYWGQGTLVTVSS |
| 222 | 2H03 | EVQLVESGGGLVQPGGSLTLSCVASGSTSSINAMAWYRRAPGKQRELVAGISSDGSKVYAD<br>SVKGRFTISRDNAKNSVYLQMNSLRAEDTAVYYCYYFRQVSGSSMRYWGQGTLVTVSS |
| 223 | 2H04 | EVQLVESGGGLVQPGGSLTLSCVASGSTSSINAMGWYRRAPGKQRELVAGISSDTSKVYAD<br>SVKGRFTISRDNAKNSVYLQMNSLRAEDTAVYYCYYFRTVSGSYMRYWGQGTLVTVSS |
| 224 | 2H06 | EVQLVESGGGLVQPGGSLTLSCVASGSTSTINAMGWYRRAPGKQRELVAGISSDGSKVYAD<br>SVKGRFTISRDNAKNSVYLQMNSLRAEDTAVYYCYYFRTASGSSMRYWGQGTLVTVSS |
| 225 | 2H07 | EVQLVESGGGLVQPGGSLTLSCVASGSTSSINAVGWYRRAPGKQRELVAGISSDGSTVYAD<br>SVKGRFTISRDNAKNSVYLQMNSLRAEDTAVYYCYYFRTVSGHSMRYWGQGTLVTVSS |
| 226 | 2H08 | EVQLVESGGGLVQPGGSLTLSCVASGSTSSINAMGWYRRAPGKQRELAAGISKDGSKVYAD<br>SAKGRFTISRDNAKNSVYLQMNSLRAEDTAVYYCYYFRTVSGSSSRYWGQGTLVTVSS |
| 227 | 2E05-M106Y | EVQLVESGGGLVQPGGSLTLSCVASGSPSSINAYGWYRRAPGKQRELVAGISSDGSKVYSD<br>SVKGRFTISRDNAKNSVYLQMNSLRAEDTAVYYCYYFRTVSGSSYSYWGQGTLVTVSS |
| 228 | 2E05-M106Q | EVQLVESGGGLVQPGGSLTLSCVASGSPSSINAYGWYRRAPGKQRELVAGISSDGSKVYSD<br>SVKGRFTISRDNAKNSVYLQMNSLRAEDTAVYYCYYFRTVSGSSQSYWGQGTLVTVSS |
| 229 | 3A01 | EVQLVESGGGLVQPGGSLTLSCAASGSSVKFLSMAWYRQAPGKKRELVAGISADGSTDYID<br>SVKGRFTISRDNAKNSVYLQMNSLRAEDTAVYYCYAYRWTRRYTYWGQGTLVTVSS |

| | | |
|---|---|---|
| 230 | 3A02 | EVQLVESGGGLVQPGGSLTLSCAASGSSVSFLSLAWYRQAPGKKRELVAGISADGSTAYID<br>SVKGRFTISRDNAKNSVYLQMNSLRAEDTAVYYCYAYRWRTRYTYWGQGTLVTVSS |
| 231 | 3A03 | EVQLVESGGGLVQPGGSLTLSCAASGSRVSFLSMAWYRQAPGKKRELVAGISRDGSTDYID<br>SVKGRFTISRDNAKNSVYLQMNSLRAEDTAVYYCYAYRWTTRRTYWGQGTLVTVSS |
| 232 | 3A04 | EVQLVESGGGLVQPGGSLTLSCAASGSQVSFLSMAWYRQAPGKKRELVAGISRDGSTDYID<br>SVKGRFTISRDNAKNSVYLQMNSLRAEDTAVYYCYAYRWTTRYIYWGQGTLVTVSS |
| 233 | 3A05 | EVQLVESGGGLVQPGGSLTLSCAASGSSVSFLSMAWYRQAPGKKRELVAGISEAGSTDYID<br>SVKGRFTISRDNAKNSVYLQMNSLRAEDTAVYYCYAYRWRTRYTYWGQGTLVTVSS |
| 234 | 3A06 | EVQLVESGGGLVQPGGSLTLRCAASGSKVSFLSMAWYRQAPGKKRELVAGISADGSTDYVD<br>SVKGRFTISRDNAKNSVYLQMNSLRAEDTAVYYCYAYRWTRRYTYWGQGTLVTVSS |
| 235 | 3A08 | EVQLVESGGGLVQPGGSLTLSCAASGSSVGFLSMAWYRQAPGKKRELVAGISADGSTDYIR<br>SVKGRFTISRDNAKNSVYLQMNSLRAEDTAVYYCYAYRWRTRYTYWGQGTLVTVSS |
| 236 | 3A09 | EVQLVESGGGLVQPGGSLTLSCAASGSSVSFLSMAWYRQAPGKKRELVAGISADGSVDYID<br>SVKGRFTISRDNAKNSVYLQMNSLRAEDTAVYYCYAYRWTTRYIYWGQGTLVTVSS |
| 237 | 3A010 | EVQLVESGGGLVQPGGSLTLSCAASGSRVSFLSMAWYRQAPGKKRELVAGISADGSTLYID<br>SVKGRFTISRDNAKNSVYLQMNSLRAEDTAVYYCYAYRWTTRRTYWGQGTLVTVSS |
| 238 | 3A011 | EVQLVESGGGLVQPGGSLTLSCAASGSSVSFLSLAWYRQAPGKKRELVAGISTDGSTDYID<br>SVKGRFTISRDNAKNSVYLQMNSLRAEDTAVYYCYAYRWRTRYTYWGQGTLVTVSS |
| 239 | 3B01 | EVQLVESGGGLVQPGGSLTLSCAASGSSVSFLSMAWYRQAPGKKRELVAGISGDGSTDYID<br>SVKGRFTISRDNAKNSVYLQMNSLRAEDTAVYYCYAYRWTTRYTYWGQGTLVTVSS |
| 240 | 3B02 | EVQLVESGGGLVQPGGSLTLSCAASGSSVQFLSMAWYRQAPGKKRELVAGISADGSTDYIN<br>SVKGRFTISRDNAKNSVYLQMNSLRAEDTAVYYCYAYRWRTRYTYWGQGTLVTVSS |
| 241 | 3B04 | EVQLVESGGGLVQPGGSLTLSCAASGSNVSFLSMAWYRQAPGKKRELVAGISARGSTDYID<br>SVKGRFTISRDNAKNSVYLQMNSLRAEDTAVYYCYAYHWTTRYTYWGQGTLVTVSS |
| 242 | 3B05 | EVQLVESGGGLVQPGGSLTLSCVASGSSVKFLSMAWYRQAPGKKRELVAGISADGSTTYID<br>SVKGRFTISRDNAKNSVYLQMNSLRAEDTAVYYCYAYRWTTRRTYWGQGTLVTVSS |
| 243 | 3B06 | EVQLVESGGGLVQPGGSLTLSCAASGKSVSFLSMAWYRQAPGKKRELVAGISKDGSTDYID<br>SVKGRFTISRDNAKNSVYLQMNSLRAEDTAVYYCYAYRWTTRYTYWGQGTLVTVSS |
| 244 | 3B07 | EVQLVESGGGLVQPGGSLTLSCAASGSRVSFLSMAWYRQAPGKKRELVAGISADGSTTYID<br>SVKGRFTISRDNAKNSVYLQMNSLRAEDTAVYYCYAYRWTTRYTYWGQGTLVTVSS |
| 245 | 3B09 | EVQLVESGGGLVQPGGSLTLSCAASGSHVSFLSMAWYRQAPGKKRELVAGISANGSTDYID<br>SVKGRFTISRDNAKNSVYLQMNSLRAEDTAVYYCYAYRWTTRYAYWGQGTLVTVSS |
| 246 | 3B010 | EVQLVESGGGLVQPGGSLTLSCAASGSSVSFLSMAWYRQAPGKKRELVAGISRDGSTDYID<br>SVKGRFTISRDNAKNSVYLQMNSLRAEDTAVYYCYAYRWVTRYTYWGQGTLVTVSS |
| 247 | 3B011 | EVQLVESGGGLVQPGGSLTLSCAASGSSVSFLSMAWYRQAPGKKRELVAGISADGSADYID<br>SVKGRFTISRDNAKNSVYLQMNSLRAEDTAVYYCYAYRWVTRYTYWGQGTLVTVSS |
| 248 | 3C01 | EVQLVESGGGLVQPGGSLTLSCAASGSSVRFLSMAWYRQAPGKKRELVAGISAHGSTDYID<br>SVKGRFTISRDNAKNSVYLQMNSLRAEDTAVYYCYAYRWSTRYTYWGQGTLVTVSS |
| 249 | 3C02 | EVQLVESGGGLVQPGGSLTLSCAASGSSVRFLSMAWYRQAPGKKRELVAGISADGSTIYID<br>SVKGRFTISRDNAKNSVYLQMNSLRAEDTAVYYCYAYRWRTRYTYWGQGTLVTVSS |
| 250 | 3C03 | EVQLVESGGGLVQPGGSLTLSCAASGSSVRFLSMAWYRQAPGKKRELVAGISRDGSTVYID<br>SVKGRFTISRDNAKNSVYLQMNSLRAEDTAVYYCYAYRWTTRGTYWGQGTLVTVSS |
| 251 | 3C04 | EVQLVESGGGLVQPGGSLTLSCAASGSHVSFLSMAWYRQAPGKKRELVAGISADGPTDYID<br>SVKGRFTISRDNAKNSVYLQMNSLRAEDTAVYYCYAYRWDTRYTYWGQGTLVTVSS |
| 252 | 3C05 | EVQLVESGGGLVQPGGSLTLSCVASGTSVSFLSMAWYRQAPGKKRELVAGISADGSTTYID<br>SVKGRFTISRDNAKNSVYLQMNSLRAEDTAVYYCYAYRWTTRRTYWGQGTLVTVSS |
| 253 | 3C06 | EVQLVESGGGLVQPGGSLTLSCAASGTSVSFLSIAWYRQAPGKKRELVAGISADGSTDYIA<br>SVKGRFTISRDNAKNSVYLQMNSLRAEDTAVYYCYAYRWRTRYTYWGQGTLVTVSS |
| 254 | 3C08 | EVQLVESGGGLVQPGGSLTLSCAASGSSVKFLSMAWYRQAPGKKRELVAGISLDGSTDYID<br>SVKGRFTISRDNAKNSVYLQMNSLRAEDTAVYYCYAYRWTGRYTYWGQGTLVTVSS |
| 255 | 3C09 | EVQLVESGGGLVQPGGSLTLSCAASGSSVSFLSMAWYRQAPGKKRELVAGISADGSTIYID<br>SVKGRFTISRDNAKNSVYLQMNSLRAEDTAVYYCYAYRWRTRYTYWGQGTLVTVSS |

| | | |
|---|---|---|
| 256 | 3C011 | EVQLVESGGGLVQPGGSLTLSCAASGSSVRFLSMAWYRQAPGKKRELVAGISAHGSTDYID<br>SVKGRFTISRDNAKNSVYLQMNSLRAEDTAVYYCYAYRWRTRYTYWGQGTLVTVSS |
| 257 | 3D01 | EVQLVESGGGLVQPGGSLTLSCAASGSSVSFLSMAWYRQAPGKKRELVAGISRDGSTDYID<br>SVKGRFTISRDNAKNSVYLQMNSLRAEDTAVYYCYAYRWITRYTYWGQGTLVTVSS |
| 258 | 3D02 | EVQLVESGGGLVQPGGSLTLSCAASGSSVRFLSMAWYRQAPGKKRELVAGISRDGSTDYID<br>SVKGRFTISRDNAKNSVYLQMNSLRAEDTAVYYCYAYRWITRYTYWGQGTLVTVSS |
| 259 | 3D03 | EVQLVESGGGLVQPGGSLTLSCAASGSSVVFLSMAWYRQAPGKKRELVAGISADGSMDYID<br>SVKGRFTISRDNAKNSVYLQMNSLRAEDTAVYYCYAYRWRTRYTYWGQGTLVTVSS |
| 260 | 3D05 | EVQLVESGGGLVQPGGSLTLSCAASGSSVRFLSMAWYRQAPGKKRELVAGISADGSTDYID<br>SVKGRFTISRDNAKNSVYLQMNSLRAEDTAVYYCYAYRWTRRYTYWGQGTLVTVSS |
| 261 | 3D07 | EVQLVESGGGLVQPGGSLTLSCAASGSSVRFLSMAWYRQAPGKKRELVAGISADGSTDYID<br>SVKGRFTISRDNAKNSVYLQMNSLRAEDTAVYYCYAYSWTTRYTYWGQGTLVTVSS |
| 262 | 3D08 | EVQLVESGGGLVQPGGSLTLSCAASGSSVRFLSMAWYRQAPGKKRELVAGISANGSTDYID<br>SVKGRFTISRDNAKNSVYLQMNSLRAEDTAVYYCYAYRWTNRYTYWGQGTLVTVSS |
| 263 | 3D09 | EVQLVESGGGLVQPGGSLTLSCAASGSSVSRLSMAWYRQAPGKKRELVAGISANGSTTYID<br>SVKGRFTISRDNAKNSVYLQMNSLRAEDTAVYYCYAYRWTTRYRYWGQGTLVTVSS |
| 264 | 3D010 | EVQLVESGGGLVQPGGSLTLSCAASGSSKSFLSMAWYRQAPGKKRELVAGISADGSTSYID<br>SVKGRFTISRDNAKNSVYLQMNSLRAEDTAVYYCYAYRWTTRYTYWGQGTLVTVSS |
| 265 | 3D011 | EVQLVESGGGLVQPGGSLTLSCAASGSSVSRLSMAWYRQAPGKKRELVAGISADGSRDYID<br>SVKGRFTISRDNAKNSVYLQMNSLRAEDTAVYYCYAYRWTTRYKYWGQGTLVTVSS |
| 266 | 3E01 | EVQLVESGGGLVQPGGSLTLSCAASGSSVKFLSMAWYRQAPGKKRELVAGISADGSTMYID<br>SVKGRFTISRDNAKNSVYLQMNSLRAEDTAVYYCYAYRWHTRYTYWGQGTLVTVSS |
| 267 | 3E02 | EVQLVESGGGLVQPGGSLTLSCAASGSGVRFLSMAWYRQAPGKKRELVAGISPDGSTDYID<br>SVKGRFTISRDNAKNSVYLQMNSLRAEDTAVYYCYAYRWTRRYTYWGQGTLVTVSS |
| 268 | 3E03 | EVQLVESGGGLVQPGGSLTLSCAASGSSVRFLSMAWYRQAPGKKRELVAGISGDGSTDYID<br>SVKGRFTISRDNAKNSVYLQMNSLRAEDTAVYYCYAYRWMTRYTYWGQGTLVTVSS |
| 269 | 3E04 | EVQLVESGGGLVQPGGSLTLSCAASGSSVHFLSMAWYRQAPGKKRELVAGISRDGSTDYID<br>SVKGRFTISRDNAKNSVYLQMNSLRAEDTAVYYCYAYRWTTRYRYWGQGTLVTVSS |
| 270 | 3E09 | EVQLVESGGGLVQPGGSLTLSCAASGSSVRFLSMAWYRQAPGKKRELVAGISRDGSTDYID<br>SVKGRFTISRDNAKNSVYLQMNSLRAEDTAVYYCYAYRWSTRYTYWGQGTLVTVSS |
| 271 | 3E011 | EVQLVESGGGLVQPGGSLTLSCAASGSKVSFLSMAWYRQAPGKKRELVAGISRDGSTDYID<br>SVKGRFTISRDNAKNSVYLQMNSLRAEDTAVYYCYAYRWTTRYTFWGQGTLVTVSS |
| 272 | 3F03 | EVQLVESGGGLVQPGGSLTLSCAASGSSVSFLSMAWYRQAPGKKRELVAGISADGSTDYID<br>SVKGRFTISRDNAKNSVYLQMNSLRAEDTAVYYCYAYRWRTRYTYWGQGTLVTVSS |
| 273 | 3F05 | EVQLVESGGGLVQPGGSLTLSCAASGSKVSFLSMAWYRQAPGKKRELVAGISTDGSTDYID<br>SVKGRFTISRDNAKNSVYLQMNSLRAEDTAVYYCYAYRWTTRRTYWGQGTLVTVSS |
| 274 | 3F06 | EVQLVESGGGLVQPGGSLTLSCAASGSRVSFLSMAWYRQAPGKKRELVAGISADGSTSYID<br>SVKGRFTISRDNAKNSVYLQMNSLRAEDTAVYYCYAYRWATRYTYWGQGTLVTVSS |
| 275 | 3F08 | EVQLVESGGGLVQPGGSLTLSCAASGSRVSFLSMAWYRQAPGKKRELVAGISADGSTLYID<br>SVKGRFTISRDNAKNSVYLQMNSLRAEDTAVYYCYAYRWHTRYTYWGQGTLVTVSS |
| 276 | 3F09 | EVQLVESGGGLVQPGGSLTLSCAASGSSVRFLSMAWYRQAPGKKRELVAGISRDGSTDYID<br>SVKGRFTISRDNAKNSVYLQMNSLRAEDTAVYYCYAYRWGTRYTYWGQGTLVTVSS |
| 277 | 3F010 | EVQLVESGGGLVQPGGSLTLSCAASYSSVSRLSMAWYRQAPGKKRELVAGISADGSTVYID<br>SVKGRFTISRDNAKNSVYLQMNSLRAEDTAVYYCYAYRWTTRNTYWGQGTLVTVSS |
| 278 | 3F011 | EVQLVESGGGLVQPGGSLTLSCAASGSSVSFLSMAWYRQAPGKKRELVAGISTDGSTDYID<br>SVKGRFTISRDNAKNSVYLQMNSLRAEDTAVYYCYAYRWRTRYTYWGQGTLVTVSS |
| 279 | 3G01 | EVQLVESGGGLVQPGGSLTLSCAASGSSVSFLSMAWYRQAPGKKRELVAGISADGSTLYID<br>SVKGRFTISRDNAKNSVYLQMNSLRAEDTAVYYCYAYRWTTRYAYWGQGTLVTVSS |
| 280 | 3G02 | EVQLVESGGGLVQPGGSLTLSCAASGSSVSFLSMAWYRQAPGKKRELVAGISADGRTDYID<br>SVKGRFTISRDNAKNSVYLQMNSLRAEDTAVYYCYAYRWRTRYTYWGQGTLVTVSS |
| 281 | 3G04 | EVQLVESGGGLVQPGGSLTLSCVASGTSVSFLSMAWYRQAPGKKRELVAGISADGSTIYID<br>SVKGRFTISRDNAKNSVYLQMNSLRAEDTAVYYCYAYRWTTRRTYWGQGTLVTVSS |

-continued

| 282 | 3G06 | EVQLVESGGGLVQPGGSLTLSCAASGSSVKFLSMAWYRQAPGKKRELVAGISADGSTLYID<br>SVKGRFTISRDNAKNSVYLQMNSLRAEDTAVYYCYAYRWTTRRTYWGQGTLVTVSS |
| --- | --- | --- |
| 283 | 3G07 | EVQLVESGGGLVQPGGSLTLSCAASGSSVSFLSMAWYRQAPGKKRELVAGISRDGSTDYID<br>SVKGRFTISRDNAKNSVYLQMNSLRAEDTAVYYCYAYRWTSRYTYWGQGTLVTVSS |
| 284 | 3G08 | EVQLVESGGGLVQPGGSLTLSCAASGSRVSFLSMAWYRQAPGKKRELVAGISKDGSTDYID<br>SVKGRFTISRDNAKNSVYLQMNSLRAEDTAVYYCYAYRWTTRVTYWGQGTLVTVSS |
| 285 | 3G09 | EVQLVESGGGLVQPGGSLTLSCAASGSSVSVLSMAWYRQAPGKKRELVAGISADGSTDYIG<br>SVKGRFTISRDNAKNSVYLQMNSLRAEDTAVYYCYAYRWTTRTTYWGQGTLVTVSS |
| 286 | 3G010 | EVQLVESGGGLVQPGGSLTLSCAASGSSVSFLSMAWYRQAPGKKRELVAGISVDGSTDYID<br>SVKGRFTISRDNAKNSVYLQMNSLRAEDTAVYYCYAYRWRTRYTYWGQGTLVTVSS |
| 287 | 3G011 | EVQLVESGGGLVQPGGSLTLSCAASGSRVSFLSMAWYRQAPGKKRELVAGISADGSTGYID<br>SVKGRFTISRDNAKNSVYLQMNSLRAEDTAVYYCYAYRWATRYTYWGQGTLVTVSS |
| 288 | 3H01 | EVQLVESGGGLVQPGGSLTLSCVASGSSVKFLSMAWYRQAPGKKRELVAGISGDGSTTYID<br>SVKGRFTISRDNAKNSVYLQMNSLRAEDTAVYYCYAYRWTTRRTYWGQGTLVTVSS |
| 289 | 3H03 | EVQLVESGGGLVQPGGSLTLSCAASGSRVSFLSMAWYRQAPGKKRELVAGISTDGSTDYID<br>SVKGRFTISRDNAKNSVYLQMNSLRAEDTAVYYCYALRWTTRYTYWGQGTLVTVSS |
| 290 | 3H06 | EVQLVESGGGLVQPGGSLTLSCAASGSSVSQLSMAWYRQAPGKKRELVAGISADGSTDYFD<br>SVKGRFTISRDNAKNSVYLQMNSLRAEDTAVYYCYAYRWTTRGTYWGQGTLVTVSS |
| 291 | 3H07 | EVQLVESGGGLVQPGGSLTLSCAASGSRVSFLSMAWYRQAPGKKRELVAGISADGSTSYID<br>SVKGRFTISRDNAKNSVYLQMNSLRAEDTAVYYCYAYRWRTRYTYWGQGTLVTVSS |
| 292 | 3H09 | EVQLVESGGGLVQPGGSLTLSCAASKSSVSFLSMAWYRQAPGKKRELVAGISADGSTDYID<br>SVKGRFTISRDNAKNSVYLQMNSLRAEDTAVYYCYAYRWTTRATYWGQGTLVTVSS |
| 293 | 3H010 | EVQLVESGGGLVQPGGSLTLSCAASGSSVSFLSMAWYRQAPGKKRELVAGISADGSTAYID<br>SVKGRFTISRDNAKNSVYLQMNSLRAEDTAVYYCYAYRWTTRRTYWGQGTLVTVSS |
| 294 | 3H011 | EVQLVESGGGLVQPGGSLTLSCAASGSSVKFLSMAWYRQAPGKKRELVAGISADGSTVYID<br>SVKGRFTISRDNAKNSVYLQMNSLRAEDTAVYYCYAYRWPTRYTYWGQGTLVTVSS |
| 295 | 4A01 | EVQLVESGGGLVQPGGSLTLSCAASGSSVRFLSMAWYRQAPGKKRELVAGISQDGSTDYID<br>SVKGRFTISRDNAKNSVYLQMNSLRAEDTAVYYCYAYRWRTRYTYWGQGTLVTVSS |
| 296 | 4A02 | EVQLVESGGGLVQPGGSLTLSCAASGSSVRFLSMAWYRQAPGKKRELVAGISNDGSTDYID<br>SVKGRFTISRDNAKNSVYLQMNSLRAEDTAVYYCYAYRWKTRYTYWGQGTLVTVSS |
| 297 | 4A04 | EVQLVESGGGLVQPGGSLTLSCAASGSRVSFLSMAWYRQAPGKKRELVAGISARGSTDYID<br>SVKGRFTISRDNAKNSVYLQMNSLRAEDTAVYYCYAYRWSTRYTYWGQGTLVTVSS |
| 298 | 4A05 | EVQLVESGGGLVQPGGSLTLSCAASGSSVSFLSLAWYRQAPGKKRELVAGISADGSTDYID<br>SVKGRFTISRDNAKNSVYLQMNSLRAEDTAVYYCYAYRWKTRRTYWGQGTLVTVSS |
| 299 | 4A06 | EVQLVESGGGLVQPGGSLTLSCAASGSSVRFLSMAWYRQAPGKKRELVAGISRDGSTDYID<br>SVKGRFTISRDNAKNSVYLQMNSLRAEDTAVYYCYAYRWTTRRTYWGQGTLVTVSS |
| 300 | 4A07 | EVQLVESGGGLVQPGGSLTLSCAASGSKVSFLSMAWYRQAPGKKRELVAGISADGSTLYID<br>SVKGRFTISRDNAKNSVYLQMNSLRAEDTAVYYCYAYRWTTRYRYWGQGTLVTVSS |
| 301 | 4A08 | EVQLVESGGGLVQPGGSLTLSCAASGSSVSFLSMAWYRQAPGKKRELVAGISADGSTNYID<br>SVKGRFTISRDNAKNSVYLQMNSLRAEDTAVYYCYAYRWRTRYTYWGQGTLVTVSS |
| 302 | 4A010 | EVQLVESGGGLVQPGGSLTLSCAASGSSVRFLSMAWYRQAPGKKRELVAGISADGSTVYID<br>SVKGRFTISRDNAKNSVYLQMNSLRAEDTAVYYCYAYRWTTRYKYWGQGTLVTVSS |
| 303 | 4A011 | EVQLVESGGGLVQPGGSLTLSCAASGSKVSFLSMAWYRQAPGKKRELVAGISADGSTTYID<br>SVKGRFTISRDNAKNSVYLQMNSLRAEDTAVYYCYAYRWKTRYTYWGQGTLVTVSS |
| 304 | 4A09 | EVQLVESGGGLVQPGGSLTLSCAASGSSVKFLSMAWYRQAPGKKRELVAGISADGSTDYIG<br>SVKGRFTISRDNAKNSVYLQMNSLRAEDTAVYYCYAYRWTTRVTYWGQGTLVTVSS |
| 305 | 4B01 | EVQLVESGGGLVQPGGSLTLSCAASGSSVKFLSMAWYRQAPGKKRELVAGISRDGSTDYID<br>SVKGRFTISRDNAKNSVYLQMNSLRAEDTAVYYCYAYRWTTRFTYWGQGTLVTVSS |
| 306 | 4B02 | EVQLVESGGGLVQPGGSLTLSCAASGSRVSFLSMAWYRQAPGKKRELVAGISADGSTTYID<br>SVKGRFTISRDNAKNSVYLQMNSLRAEDTAVYYCYAYRWTTRFTYWGQGTLVTVSS |
| 307 | 4B04 | EVQLVESGGGLVQPGGSLTLSCAASGSSVLFLSMAWYRQAPGKKRELVAGVSSDGSTDYID<br>SVKGRFTISRDNAKNSVYLQMNSLRAEDTAVYYCYAYRWRTRYTYWGQGTLVTVSS |

| 308 | 4B05 | EVQLVESGGGLVQPGGSLTLSCAASGSRVSFLSMAWYRQAPGKKRELVAGISADGHTDYID SVKGRFTISRDNAKNSVYLQMNSLRAEDTAVYYCYAYRWTTRYTHWGQGTLVTVSS |
|---|---|---|
| 309 | 4B06 | EVQLVESGGGLVQPGGSLTLSCAASGSRVSFLSMAWYRQAPGKKRELVAGISADGSTDYED SVKGRFTISRDNAKNSVYLQMNSLRAEDTAVYYCYAYRWTRRYTYWGQGTLVTVSS |
| 310 | 4B07 | EVQLVESGGGLVQPGGSLTLSCAASGSSVGFLSMAWYRQAPGKKRELVAGISADGSTVYID SVKGRFTISRDNAKNSVYLQMNSLRAEDTAVYYCYAYRWTTRYTYWGQGTLVTVSS |
| 311 | 4B08 | EVQLVESGGGLVQPGGSLTLSCAASGSSVSFMSMAWYRQAPGKKRELVAGISADGSTDYIA SVKGRFTISRDNAKNSVYLQMNSLRAEDTAVYYCYAYRWTTRSTYWGQGTLVTVSS |
| 312 | 4B09 | EVQLVESGGGLVQPGGSLTLSCAASGSSVSFLSMAWYRQAPGKKRELVAGISADGSTDYIS SVKGRFTISRDNAKNSVYLQMNSLRAEDTAVYYCYAYSWTTRYTYWGQGTLVTVSS |
| 313 | 4B011 | EVQLVESGGGLVQPGGSLTLSCAASGSSVTFLSMAWYRQAPGKKRELVAGISADGSTVYID SVKGRFTISRDNAKNSVYLQMNSLRAEDTAVYYCYAYRWTTRGTYWGQGTLVTVSS |
| 314 | 4C01 | EVQLVESGGGLVQPGGSLTLSCAASGSSVRFLSMAWYRQAPGKKRELVAGISADGSTVYID SVKGRFTISRDNAKNSVYLQMNSLRAEDTAVYYCYAYRWKTRYTYWGQGTLVTVSS |
| 315 | 4C02 | EVQLVESGGGLVQPGGSLTLSCAASGSKVSFLSMAWYRQAPGKKRELVAGISADGSTTYID SVKGRFTISRDNAKNSVYLQMNSLRAEDTAVYYCYAYRWTTRFTYWGQGTLVTVSS |
| 316 | 4C03 | EVQLVESGGGLVQPGGSLTLSCAASGSKVSFMSMAWYRQAPGKKRELVAGISVDGSTDYID SVKGRFTISRDNAKNSVYLQMNSLRAEDTAVYYCYAYRWTRYTYWGQGTLVTVSS |
| 317 | 4C05 | EVQLVESGGGLVQPGGSLTLSCAASGSSVSNLSMAWYRQAPGKKRELVAGISADGSTAYID SVKGRFTISRDNAKNSVYLQMNSLRAEDTAVYYCYAYRWTTRRTYWGQGTLVTVSS |
| 318 | 4C06 | EVQLVESGGGLVQPGGSLTLSCAASNSSVSKLSMAWYRQAPGKKRELVAGISADGSTAYID SVKGRFTISRDNAKNSVYLQMNSLRAEDTAVYYCYAYRWSTRYTYWGQGTLVTVSS |
| 319 | 4C07 | EVQLVESGGGLVQPGGSLTLSCAASGSKVSFLSMAWYRQAPGKKRELVAGISADGSKDYID SVKGRFTISRDNAKNSVYLQMNSLRAEDTAVYYCYAYRWTTRLTYWGQGTLVTVSS |
| 320 | 4C08 | EVQLVESGGGLVQPGGSLTLSCVASGSQVSFLSMAWYRQAPGKKRELVAGISADGSTDYFD SVKGRFTISRDNAKNSVYLQMNSLRAEDTAVYYCYAYRWTRRYTYWGQGTLVTVSS |
| 321 | 4C010 | EVQLVESGGGLVQPGGSLTLSCAASGSKVSFMSMAWYRQAPGKKRELVAGISADGSTDYID SVKGRFTISRDNAKNSVYLQMNSLRAEDTAVYYCYAYRWTTRLTYWGQGTLVTVSS |
| 322 | 4C011 | EVQLVESGGGLVQPGGSLTLSCAASGSRVSFLSMAWYRQAPGKKRELVAGISADGSTVYID SVKGRFTISRDNAKNSVYLQMNSLRAEDTAVYYCYAYRWTTRRYTYWGQGTLVTVSS |
| 323 | 4D01 | EVQLVESGGGLVQPGGSLTLSCAASGSSVRFLSMAWYRQAPGKKRELVAGISADGSTVYID SVKGRFTISRDNAKNSVYLQMNSLRAEDTAVYYCYAYRWTTRRTYWGQGTLVTVSS |
| 324 | 4D02 | EVQLVESGGGLVQPGGSLTLSCAASGSKVSFLSMAWYRQAPGKKRELVAGISARGSTDYID SVKGRFTISRDNAKNSVYLQMNSLRAEDTAVYYCYAYQWTTRYTYWGQGTLVTVSS |
| 325 | 4D03 | EVQLVESGGGLVQPGGSLTLSCAASGSSVRFLSMAWYRQAPGKKRELVAGISATGSTDYID SVKGRFTISRDNAKNSVYLQMNSLRAEDTAVYYCYAYRWTTRRYTYWGQGTLVTVSS |
| 326 | 4D04 | EVQLVESGGGLVQPGGSLTLSCAASGSSVSFLSIAWYRQAPGKKRELVAGISKDGSTDYID SVKGRFTISRDNAKNSVYLQMNSLRAEDTAVYYCYAYRWTTRMTYWGQGTLVTVSS |
| 327 | 4D05 | EVQLVESGGGLVQPGGSLTLSCAASGSSSSFLSMAWYRQAPGKKRELVAGISADGSTVYID SVKGRFTISRDNAKNSVYLQMNSLRAEDTAVYYCYAYRWTTRRTYWGQGTLVTVSS |
| 328 | 4D06 | EVQLVESGGGLVQPGGSLTLSCAASGSSVKFLSMAWYRQAPGKKRELVAGISPDGSTDYID SVKGRFTISRDNAKNSVYLQMNSLRAEDTAVYYCYAYRWTTRYRYWGQGTLVTVSS |
| 329 | 4D08 | EVQLVESGGGLVQPGGSLTLSCAASGSSVNFLSMAWYRQAPGKKRELVAGISADGSTHYID SVKGRFTISRDNAKNSVYLQMNSLRAEDTAVYYCYAYRWLTRYTYWGQGTLVTVSS |
| 330 | 4D09 | EVQLVESGGGLVQPGGSLTLSCAASGSSVKFLSMAWYRQAPGKKRELVAGISADGSTDYIL SVKGRFTISRDNAKNSVYLQMNSLRAEDTAVYYCYAYEWTTRYTYWGQGTLVTVSS |
| 331 | 4D010 | EVQLVESGGGLVQPGGSLTLSCAASGSSVSFLSMAWYRQAPGKKRELVAGISADGSTDYIH SVKGRFTISRDNAKNSVYLQMNSLRAEDTAVYYCYAYRWRTRYTYWGQGTLVTVSS |
| 332 | 4D011 | EVQLVESGGGLVQPGGSLTLSCAASGSSVRFLSMAWYRQAPGKKRELVAGISVDGSTDYID SVKGRFTISRDNAKNSVYLQMNSLRAEDTAVYYCYAYRWRTRYTYWGQGTLVTVSS |
| 333 | 4E01 | EVQLVESGGGLVQPGGSLTLSCAASGSSVSFLSVAWYRQAPGKKRELVAGISRDGSTDYID SVKGRFTISRDNAKNSVYLQMNSLRAEDTAVYYCYAYRWRTRYTYWGQGTLVTVSS |

| | | |
|---|---|---|
| 334 | 4E02 | EVQLVESGGGLVQPGGSLTLSCAASGSQVSFLSMAWYRQAPGKKRELVAGISADGSTVYID<br>SVKGRFTISRDNAKNSVYLQMNSLRAEDTAVYYCYAYRWSTRYTYWGQGTLVTVSS |
| 335 | 4E06 | EVQLVESGGGLVQPGGSLTLSCAASGTSVSFLSMAWYRQAPGKKRELVAGISADGSTDYIR<br>SVKGRFTISRDNAKNSVYLQMNSLRAEDTAVYYCYAYRWTTRLTYWGQGTLVTVSS |
| 336 | 4E07 | EVQLVESGGGLVQPGGSLTLSCAASGSRVSFLSMAWYRQAPGKKRELVAGISADGSTMYID<br>SVKGRFTISRDNAKNSVYLQMNSLRAEDTAVYYCYAYRWTTRLTYWGQGTLVTVSS |
| 337 | 4E08 | EVQLVESGGGLVQPGGSLTLSCAASGSSVKFLSMAWYRQAPGKKRELVAGISTDGSTDYID<br>SVKGRFTISRDNAKNSVYLQMNSLRAEDTAVYYCYAYKWTTRYTYWGQGTLVTVSS |
| 338 | 4E09 | EVQLVESGGGLVQPGGSLTLSCAASGSSVSFLSSAWYRQAPGKKRELVAGISADGSTLYID<br>SVKGRFTISRDNAKNSVYLQMNSLRAEDTAVYYCYAYRWTTRSTYWGQGTLVTVSS |
| 339 | 4E010 | EVQLVESGGGLVQPGGSLTLSCAASGSSVKFLSMAWYRQAPGKKRELVAGISADGSTDYID<br>SVKGRFTISRDNAKNSVYLQMNSLRAEDTAVYYCYAYRWRTRYTYWGQGTLVTVSS |
| 340 | 4E011 | EVQLVESGGGLVQPGGSLTLSCAASGSSVSFLSMAWYRQAPGKKRELVAGISATGSTDYID<br>SVKGRFTISRDNAKNSVYLQMNSLRAEDTAVYYCYAYRWSTRYTYWGQGTLVTVSS |
| 341 | 4F02 | EVQLVESGGGLVQPGGSLTLSCAASGTSVSFLSMAWYRQAPGKKRELVAGISHDGSTDYID<br>SVKGRFTISRDNAKNSVYLQMNSLRAEDTAVYYCYAYRWTTRYTYWGQGTLVTVSS |
| 342 | 4F03 | EVQLVESGGGLVQPGGSLTLSCAASGSSVQFLSMAWYRQAPGKKRELVAGISYDGSTDYID<br>SVKGRFTISRDNAKNSVYLQMNSLRAEDTAVYYCYAYRWRTRYTYWGQGTLVTVSS |
| 343 | 4F04 | EVQLVESGGGLVQPGGSLTLSCAASRSSVSFLSMAWYRQAPGKKRELVAGISTDGSTDYID<br>SVKGRFTISRDNAKNSVYLQMNSLRAEDTAVYYCYAYRWLTRYTYWGQGTLVTVSS |
| 344 | 4F08 | EVQLVESGGGLVQPGGSLTLSCAASGSKVSFLSMAWYRQAPGKKRELVAGISADGSTAYID<br>SVKGRFTISRDNAKNSVYLQMNSLRAEDTAVYYCYAYRWRTRYTYWGQGTLVTVSS |
| 345 | 4F09 | EVQLVESGGGLVQPGGSLTLSCAASGSRVSFLSMAWYRQAPGKKRELVAGISADGSTDYIE<br>SVKGRFTISRDNAKNSVYLQMNSLRAEDTAVYYCYAYRWTTRYTYWGQGTLVTVSS |
| 346 | 4F010 | EVQLVESGGGLVQPGGSLTLSCAASGSSVSFLSMAWYRQAPGKKRELVAGISIDGSTDYIK<br>SVKGRFTISRDNAKNSVYLQMNSLRAEDTAVYYCYAYRWTTRYRYWGQGTLVTVSS |
| 347 | 4F011 | EVQLVESGGGLVQPGGSLTLSCAASGSKVSFLSMAWYRQAPGKKRELVAGISADGSKDYID<br>SVKGRFTISRDNAKNSVYLQMNSLRAEDTAVYYCYAYRWTTRYTYWGQGTLVTVSS |
| 348 | 4G01 | EVQLVESGGGLVQPGGSLTLSCAASGSSVRFLSMAWYRQAPGKKRELVAGISADGSTVYID<br>SVKGRFTISRDNAKNSVYLQMNSLRAEDTAVYYCYAYRWPTRYTYWGQGTLVTVSS |
| 349 | 4G02 | EVQLVESGGGLVQPGGSLTLSCAASGSSVKFLSMAWYRQAPGKKRELVAGISRDGSTDYID<br>SVKGRFTISRDNAKNSVYLQMNSLRAEDTAVYYCYAYRWTTRHTYWGQGTLVTVSS |
| 350 | 4G03 | EVQLVESGGGLVQPGGSLTLSCAASGSSVKFLSMAWYRQAPGKKRELVAGISADGSTDYIH<br>SVKGRFTISRDNAKNSVYLQMNSLRAEDTAVYYCYAYRWTTRRTYWGQGTLVTVSS |
| 351 | 4G05 | EVQLVESGGGLVQPGGSLTLSCAASGSSVSILSMAWYRQAPGKKRELVAGISADGSTIYID<br>SVKGRFTISRDNAKNSVYLQMNSLRAEDTAVYYCYAYRWHTRYTYWGQGTLVTVSS |
| 352 | 4G07 | EVQLVESGGGLVQPGGSLTLSCAASGSSVSFLSVAWYRQAPGKKRELVAGISANGSTDYID<br>SVKGRFTISRDNAKNSVYLQMNSLRAEDTAVYYCYAYRWTNRYTYWGQGTLVTVSS |
| 353 | 4G08 | EVQLVESGGGLVQPGGSLTLSCAASGSSVRFLSMAWYRQAPGKKRELVAGISTDGSTDYID<br>SVKGRFTISRDNAKNSVYLQMNSLRAEDTAVYYCYAYRWTTRYRYWGQGTLVTVSS |
| 354 | 4G09 | EVQLVESGGGLVQPGGSLTLSCAASGSRVSFLSMAWYRQAPGKKRELVAGISYDGSTDYID<br>SVKGRFTISRDNAKNSVYLQMNSLRAEDTAVYYCYAYRWTTRRTYWGQGTLVTVSS |
| 355 | 4G010 | EVQLVESGGGLVQPGGSLTLSCAASGHSVSFLSMAWYRQAPGKKRELVAGISADGSTDYIA<br>SVKGRFTISRDNAKNSVYLQMNSLRAEDTAVYYCYAYRWSTRYTYWGQGTLVTVSS |
| 356 | 4G011 | EVQLVESGGGLVQPGGSLTLSCAASGSSVRFLSMAWYRQAPGKKRELVAGISADGSTDYIG<br>SVKGRFTISRDNAKNSVYLQMNSLRAEDTAVYYCYAYRWSTRYTYWGQGTLVTVSS |
| 357 | 4H01 | EVQLVESGGGLVQPGGSLTLSCAASGSSVSFLSMAWYRQAPGKKRELVAGISANGSTDYYD<br>SVKGRFTISRDNAKNSVYLQMNSLRAEDTAVYYCYAYRWRTRYTYWGQGTLVTVSS |
| 358 | 4H03 | EVQLVESGGGLVQPGGSLTLSCAASGSRVSFLSMAWYRQAPGKKRELVAGISADGSTSYID<br>SVKGRFTISRDNAKNSVYLQMNSLRAEDTAVYYCYAYRWTTRYTYWGQGTLVTVSS |
| 359 | 4H04 | EVQLVESGGGLVQPGGSLTLSCAASGSSVKFLSMAWYRQAPGKKRELVAGVSADGSTDYID<br>SVKGRFTISRDNAKNSVYLQMNSLRAEDTAVYYCYAYEWTTRYTYWGQGTLVTVSS |

| 360 | 4H05 | EVQLVESGGGLVQPGGSLTLSCAASGSSVSRLSMAWYRQAPGKKRELVAGISARGSTDYID SVKGRFTISRDNAKNSVYLQMNSLRAEDTAVYYCYAYRWTTRSTYWGQGTLVTVSS |
| --- | --- | --- |
| 361 | 4H06 | EVQLVESGGGLVQPGGSLTLSCAASGRSVSFLSMAWYRQAPGKKRELVAGISADGSTIYID SVKGRFTISRDNAKNSVYLQMNSLRAEDTAVYYCYAYRWTTRYTYWGQGTLVTVSS |
| 362 | 4H07 | EVQLVESGGGLVQPGGSLTLSCAASGRSVSFLSMAWYRQAPGKKRELVAGISANGSTDYID SVKGRFTISRDNAKNSVYLQMNSLRAEDTAVYYCYAYRWSTRYTYWGQGTLVTVSS |
| 363 | 4H08 | EVQLVESGGGLVQPGGSLTLSCAASGSSVKFLSMAWYRQAPGKKRELVAGISADGSTDYVD SVKGRFTISRDNAKNSVYLQMNSLRAEDTAVYYCYAYRWSTRYTYWGQGTLVTVSS |
| 364 | 4H09 | EVQLVESGGGLVQPGGSLTLSCAASGSSVSKLSMAWYRQAPGKKRELVAGISADGSTDYRD SVKGRFTISRDNAKNSVYLQMNSLRAEDTAVYYCYAYRWTYRYTYWGQGTLVTVSS |
| 365 | 4H011 | EVQLVESGGGLVQPGGSLTLSCAASGSSVSRLSMAWYRQAPGKKRELVAGISVDGSTDYID SVKGRFTISRDNAKNSVYLQMNSLRAEDTAVYYCYAYRWTTRLTYWGQGTLVTVSS |
| 366 | 4D09-M34L | EVQLVESGGGLVQPGGSLTLSCAASGSSVKFLSLAWYRQAPGKKRELVAGISADGSTDYIL SVKGRFTISRDNAKNSVYLQMNSLRAEDTAVYYCYAYEWTTRYTYWGQGTLVTVSS |
| 367 | 4H11-M34L | EVQLVESGGGLVQPGGSLTLSCAASGSSVSRLSLAWYRQAPGKKRELVAGISVDGSTDYID SVKGRFTISRDNAKNSVYLQMNSLRAEDTAVYYCYAYRWTTRLTYWGQGTLVTVSS |
| 368 | 41B11 | EVQLVESGGGLVQPGGSLTLSCVASGTSSSINAMGWYRRAPGKQRELVAGISSDGSKVFNE SVKGRFTISRDNAKNSVYLQMNSLRAEDTAVYYCYYFRPAAGSPMRYWGQGTLVTVSS |
| 369 | 41C02 | EVQLVESGGGLVQPGGSLTLSCVASGTTSSINAIGWYRRAPGKQRELVAGISSDGSEVYTD SVKGRFTISRDNAKNSVYLQMNSLRAEDTAVYYCYYFRTVDGSPLRYWGQGTLVTVSS |
| 370 | 41D01 | EVQLVESGGGLVQPGGSLTLSCVASGSTSSINAMAWYRRAPGKQRELVAGISSDDSNVYYE SVKGRFTISRDNAKNSVYLQMNSLRAEDTAVYYCYYFRTVSGSSKRYWGQGTLVTVSS |
| 371 | 41D02 | EVQLVESGGGLVQPGGSLTLSCVASGQTYRVNAFGWYRRAPGKQRELVAGISSDGSKVYAD SVKGRFTISRDNAKNSVYLQMNSLRAEDTAVYYCYYFSAGSGTEMSYWGQGTLVTVSS |
| 372 | 41D03 | EVQLVESGGGLVQPGGSLTLSCVASGSTSSINAMAWYRRAPGKQRELVAGISSDESTLYVD SVKGRFTISRDNAKNSVYLQMNSLRAEDTAVYYCYYFGSLSGSSTTYWGQGTLVTVSS |
| 373 | 41D07 | EVQLVESGGGLVQPGGSLTLSCVASGSASLTNATGWYRRAPGKQRELVAGISSDDSKVYSD SVKGRFTISRDNAKNSVYLQMNSLRAEDTAVYYCYYFGSVSGSWTRYWGQGTLVTVSS |
| 374 | 41E01 | EVQLVESGGGLVQPGGSLTLSCVASGYPSLNNAMGWYRRAPGKQRELVAGISSDGSQVYGA SVKGRFTISRDNAKNSVYLQMNSLRAEDTAVYYCYYFRLVSGSSMSYWGQGTLVTVSS |
| 375 | 41E02 | EVQLVESGGGLVQPGGSLTLSCVASGSSSTINAIGWYRRAPGKQRELVAGISSDGSKVYAD SVKGRFTISRDNAKNSVYLQMNSLRAEDTAVYYCYYFRTGSGTSKSYWGQGTLVTVSS |
| 376 | 41F07 | EVQLVESGGGLVQPGGSLTLSCVASGSTSYINAMGWYRRAPGKQRELVAGISSDGSNMYAD SVKGRFTISRDNAKNSVYLQMNSLRAEDTAVYYCYYFSNMSGTTRRYWGQGTLVTVSS |
| 377 | 41G01 | EVQLVESGGGLVQPGGSLTLSCVASGSTSSVNALGWYRRAPGKQRELVAGISSDGSKVYTD SVKGRFTISRDNAKNSVYLQMNSLRAEDTAVYYCYYFRTVPGSAMGYWGQGTLVTVSS |
| 378 | 42A03 | EVQLVESGGGLVQPGGSLTLSCVASGSTSLSNAVGWYRRAPGKQRELVAGISSDGSKVSAE SVKGRFTISRDNAKNSVYLQMNSLRAEDTAVYYCYYFRAESGSSMGYWGQGTLVTVSS |
| 379 | 42A06 | EVQLVESGGGLVQPGGSLTLSCVASGSTSSTNAIGWYRRAPGKQRELVAGISSDGSKVYDD SVKGRFTISRDNAKNSVYLQMNSLRAEDTAVYYCYYFRTLYGSSRSYWGQGTLVTVSS |
| 380 | 42A07 | EVQLVESGGGLVQPGGSLTLSCVASGLTSTINAMGWYRRAPGKQRELVAGISSDGSKVYDD SVKGRFTISRDNAKNSVYLQMNSLRAEDTAVYYCYYFSPFSGSDTGYWGQGTLVTVSS |
| 381 | 42A08 | EVQLVESGGGLVQPGGSLTLSCVASGVSPSKNAIGWYRRAPGKQRELVAGISSDGSAVYVG SVKGRFTISRDNAKNSVYLQMNSLRAEDTAVYYCYYFSTFSGSSISYWGQGTLVTVSS |
| 382 | 42A11 | EVQLVESGGGLVQPGGSLTLSCVASGSTSSINAVGWYRRAPGKQRELVAGISSDGSYVYSE SVKGRFTISRDNAKNSVYLQMNSLRAEDTAVYYCYYFRTLAGSEMRYWGQGTLVTVSS |
| 383 | 42B06 | EVQLVESGGGLVQPGGSLTLSCVASGSTTMNNAMAWYRRAPGKQRELVAGISSDSHVYAD SVKGRFTISRDNAKNSVYLQMNSLRAEDTAVYYCYYFRTVSGSGVRYWGQGTLVTVSS |
| 384 | 42B10 | EVQLVESGGGLVQPGGSLTLSCVASGSTSKINAIGWYRRAPGKQRELVAGISSDSSIVYTD SVKGRFTISRDNAKNSVYLQMNSLRAEDTAVYYCYYFRPGAGHSNSYWGQGTLVTVSS |
| 385 | 42C01 | EVQLVESGGGLVQPGGSLTLSCVASGQTTALNAMGWYRRAPGKQRELVAGISSDGSEVNTD SVKGRFTISRDNAKNSVYLQMNSLRAEDTAVYYCYYFRRASGTAMSYWGQGTLVTVSS |

| | | -continued |
|---|---|---|
| 386 | 42C03 | EVQLVESGGGLVQPGGSLTLSCVASGATSSINAIGWYRRAPGKQRELVAGISSDGSKLSSD<br>SVKGRFTISRDNAKNSVYLQMNSLRAEDTAVYYCYYFTSASGTDLSYWGQGTLVTVSS |
| 387 | 42C07 | EVQLVESGGGLVQPGGSLTLSCVASGSTSTINAMGWYRRAPGKQRELVAGISSDNSKVYAD<br>SVKGRFTISRDNAKNSVYLQMNSLRAEDTAVYYCYYFRSANGSSKRYWGQGTLVTVSS |
| 388 | 42C08 | EVQLVESGGGLVQPGGSLTLSCVASGSTSSINAMGWYRRAPGKQRELVAGISSDGSRVYFD<br>SVKGRFTISRDNAKNSVYLQMNSLRAEDTAVYYCYYFKTIAGAGMRYWGQGTLVTVSS |
| 389 | 42C10 | EVQLVESGGGLVQPGGSLTLSCVASGSTSLVNAMGWYRRAPGKQRELVAGISSDGSLVYAE<br>SVKGRFTISRDNAKNSVYLQMNSLRAEDTAVYYCYYFRYGSGSSLSYWGQGTLVTVSS |
| 390 | 42C11 | EVQLVESGGGLVQPGGSLTLSCVASGSTSLNNAIGWYRRAPGKQRELVAGISSDGSVVYVD<br>SVKGRFTISRDNAKNSVYLQMNSLRAEDTAVYYCYYFRTVPGASMKYWGQGTLVTVSS |
| 391 | 42D05 | EVQLVESGGGLVQPGGSLTLSCVASGSTSPVNAMAWYRRAPGKQRELVAGISSDGSKVYVD<br>SVKGRFTISRDNAKNSVYLQMNSLRAEDTAVYYCYYFRTVDGSAISYWGQGTLVTVSS |
| 392 | 42D06 | EVQLVESGGGLVQPGGSLTLSCVASGTTSSMNAIGWYRRAPGKQRELVAGISSDGSKLYDE<br>SVKGRFTISRDNAKNSVYLQMNSLRAEDTAVYYCYYFRTVKGSGGSYWGQGTLVTVSS |
| 393 | 42D07 | EVQLVESGGGLVQPGGSLTLSCVASGETSSINAMAWYRRAPGKQRELVAGISSDYSKLYAD<br>SVKGRFTISRDNAKNSVYLQMNSLRAEDTAVYYCYYFRTVSGSSRGYWGQGTLVTVSS |
| 394 | 42D08 | EVQLVESGGGLVQPGGSLTLSCVASGSTSTINAIGWYRRAPGKQRELVAGISSDSSKVYTE<br>SVKGRFTISRDNAKNSVYLQMNSLRAEDTAVYYCYYFRPGPGSQMAYWGQGTLVTVSS |
| 395 | 42E01 | EVQLVESGGGLVQPGGSLTLSCVASGSTYSMNAMGWYRRAPGKQRELVAGISSDGSQVYVD<br>SVKGRFTISRDNAKNSVYLQMNSLRAEDTAVYYCYYFRTVAGSASGYWGQGTLVTVSS |
| 396 | 42E02 | EVQLVESGGGLVQPGGSLTLSCVASGSPSSINAYGWYRRAPGKQRELVAGISSDGSKVYSD<br>SVKGRFTISRDNAKNSVYLQMNSLRAEDTAVYYCYYFRTVSGSSYSYWGQGTLVTVSS |
| 397 | 42E05 | EVQLVESGGGLVQPGGSLTLSCVASGSTSTINAIGWYRRAPGKQRELVAGISSDGSKVYVD<br>SVKGRFTISRDNAKNSVYLQMNSLRAEDTAVYYCYYFINLKGSSMAYWGQGTLVTVSS |
| 398 | 42E06 | EVQLVESGGGLVQPGGSLTLSCVASGSTSSINAIGWYRRAPGKQRELVAGISSDGSKVYAD<br>SVKGRFTISRDNAKNSVYLQMNSLRAEDTAVYYCYYFRMVTGSYGGYWGQGTLVTVSS |
| 399 | 42E07 | EVQLVESGGGLVQPGGSLTLSCVASGSISSINAMGWYRRAPGKQRELVAGISSDGSSVYAD<br>SVKGRFTISRDNAKNSVYLQMNSLRAEDTAVYYCYYFKSSYGLPMRYWGQGTLVTVSS |
| 400 | 42F01 | EVQLVESGGGLVQPGGSLTLSCVASGSTQVNNAMAWYRRAPGKQRELVAGISSDGSQVYYG<br>SVKGRFTISRDNAKNSVYLQMNSLRAEDTAVYYCYYFKTVSGQSLRYWGQGTLVTVSS |
| 401 | 42F08 | EVQLVESGGGLVQPGGSLTLSCVASGSTASFNAMAWYRRAPGKQRELVAGISSDGSKVYTD<br>SVKGRFTISRDNAKNSVYLQMNSLRAEDTAVYYCYYFRTVTGRAARYWGQGTLVTVSS |
| 402 | 42F10 | EVQLVESGGGLVQPGGSLTLSCVASGSPLSINAIGWYRRAPGKQRELVAGISSDGSKVSAD<br>SVKGRFTISRDNAKNSVYLQMNSLRAEDTAVYYCYYFGPAIGASRTYWGQGTLVTVSS |
| 403 | 42G05 | EVQLVESGGGLVQPGGSLTLSCVASGSTTFINAIGWYRRAPGKQRELVAGISSDGSKVYED<br>SVKGRFTISRDNAKNSVYLQMNSLRAEDTAVYYCYYFRTVSGAPKSYWGQGTLVTVSS |
| 404 | 42G07 | EVQLVESGGGLVQPGGSLTLSCVASGSTSSINAIGWYRRAPGKQRELVAGISSDRSKVYAD<br>SVKGRFTISRDNAKNSVYLQMNSLRAEDTAVYYCYYFHTVSGSSMSYWGQGTLVTVSS |
| 405 | 42H05 | EVQLVESGGGLVQPGGSLTLSCVASGETDTINAVGWYRRAPGKQRELVAGISSDGSKVYAE<br>SVKGRFTISRDNAKNSVYLQMNSLRAEDTAVYYCYYFRRLEGYSNRYWGQGTLVTVSS |
| 406 | 42H08 | EVQLVESGGGLVQPGGSLTLSCVASGSTSPINAIGWYRRAPGKQRELVAGISSDGSVVTTE<br>SVKGRFTISRDNAKNSVYLQMNSLRAEDTAVYYCYYFRTGSGSSMGYWGQGTLVTVSS |
| 407 | 42H11 | EVQLVESGGGLVQPGGSLTLSCVASGSITSSNAMGWYRRAPGKQRELVAGISSDGSHVHQE<br>SVKGRFTISRDNAKNSVYLQMNSLRAEDTAVYYCYYFTTVTGSSMSYWGQGTLVTVSS |
| 408 | 51A01 | EVQLVESGGGLVQPGGSLTLSCAASRYSVSNLSMAWYRQAPGKKRELVAGISADGSTVYVE<br>SVKGRFTISRDNAKNSVYLQMNSLRAEDTAVYYCYAYYWTERRPYWGQGTLVTVSS |
| 409 | 51A02 | EVQLVESGGGLVQPGDSLTLSCAASMSTVSVLSMAWYRQAPGKKRELVAGISSDGSTVYID<br>SVKGRFTISRDNAKNSVYLQMNSLRAEDTAIYYCYAYSWDDAHPYWGQGTLVTVSS |
| 410 | 51A03 | EVQLVESGGGLVQPGGSLTLSCAASDSYVSLLSMAWYRQAPGKKRELVAGISVDSTHYVA<br>SVKGRFTISRDNAKNSVYLQMNSLRAEDTAVYYCYAYRWMTRLTYWGQGTLVTVSS |
| 411 | 51A05 | EVQLVESGGGLVQPGGSLTLSCAASDSAVSVLSIAWYRQAPGKKRELVAGISTDGSKHYID<br>SVKGRFTISRDNAKNSVYLQMNSLRAEDTAVYYCYAYDWADAQPYWGQGTLVTVSS |

-continued

| | | |
|---|---|---|
| 412 | 51B01 | EVQLVESGGGLVQPGGSLTLSCAASHSSVTSLSLAWYRQAPGKKRELVAGISYDGSKYYAESVKGRFTISRDNAKNSVYLQMNSLRAEDTAVYYCYAYSWTDRLPYWGQGTLVTVSS |
| 413 | 51B04 | EVQLVESGGGLVQPGGSLTLSCAASDSVVKFLSMAWYRQAPGKKRELVAGISANGSRTYMESVKGRFTISRDNAKNSVYLQMNSLRAEDTAVYYCYARWATRLPYWGQGTLVTVSS |
| 414 | 51B11 | EVQLVESGGGLVQPGGSLTLSCAASDPSVWNLSMAWYRQAPGKKRELVAGISPDGSTDYVDSVKGRFTISRDNAKNSVYLQMNSLRAEDTAVYYCYAYKWSNRLPYWGQGTLVTVSS |
| 415 | 51C02 | EVQLVESGGGLVQPGGSLTLSCAASGTSVMLLSLAWYRQAPGKKRELVAGISPNGSAVYTESVKGRFTISRDNAKNSVYLQMNSLRAEDTAVYYCYAYGWKTRQPYWGQGTLVTVSS |
| 416 | 51D01 | EVQLVESGGGLVQPGGSLTLSCAASSSPVSNLSLAWYRQAPGKKRELVAGISPDGSTAYMESVKGRFTISRDNAKNSVYLQMNSLRAEDTAVYYCYARWPNRRGYWGQGTLVTVSS |
| 417 | 51D03 | EVQLVESGGGLVQPGGSLTLSCAASWRSVLLLSVAWYRQAPGKKRELVAGISNDGSTDYIDSVKGRFTISRDNAKNSVYLQMNSLRAEDTAVYYCYADWTTRQRYWGQGTLVTVSS |
| 418 | 51E02 | EVQLVESGGGLVQPGGSLTLSCAASSSSVQYLSMAWYRQAPGKKRELVAGISTDGSAVYFDSVKGRFTISRDNAKNSVYLQMNSLRAEDTAVYYCYAYNWSYAQPYWGQGTLVTVSS |
| 419 | 51E03 | EVQLVESGGGLVQPGGSLTLSCAASGTSVSLLSLAWYRQAPGKKRELVAGISTGGSTHYIESVKGRFTISRDNAKNSVYLQMNSLRAEDTAVYYCYAYNWTDSLQYWGQGTLVTVSS |
| 420 | 51E05 | EVQLVESGGGLVQPGGSLTLSCAASLSSVSNLSIAWYRQAPGKKRELVAGISTDGSTVYIDSVKGRFTISRDNAKNSVYLQMNSLRAEDTAVYYCYAYSWTTSLPYWGQGTLVTVSS |
| 421 | 51F01 | EVQLVESGGGLVQPGGSLTLSCAASMYSVSFLSMAWYRQAPGKKRELVAGISNEGSTYYMDSVKGRFTISRDNAKNSVYLQMNSLRAEDTAVYYCYAYKWRSRSTYWGQGTLVTVSS |
| 422 | 51F02 | EVQLVESGGGLVQPGGSLTLSCAASKSSVSHLSLAWYRQAPGKKRELVAGISADGSHVYTNSVKGRFTISRDNAKNSVYLQMNSLRAEDTAVYYCYAYSQTTRDPYWGQGTLVTVSS |
| 423 | 51F03 | EVQLVESGGGLVQPGGSLTLSCAASYTSVLDLSIAWYRQAPGKKRELVAGISDDGSRYYTDSVKGRFTISRDNAKNSVYLQMNSLRAEDTAVYYCYARWTARDTYWGQGTLVTVSS |
| 424 | 51F04 | EVQLVESGGGLVQPGGSLTLSCAASMSDVSFLSMAWYRQAPGKKRELVAGISAEGSTLYMESVKGRFTISRDNAKNSVYLQMNSLRAEDTAVYYCYARWTSRLSYWGQGTLVTVSS |
| 425 | 51G02 | EVQLVESGGGLVQPGGSLTLSCAASESSVSFLSSAWYRQAPGKKRELVAGISTDGSTVYIDSVKGRFTISRDNAKNSVYLQMNSLRAEDTAVYYCYAYSWTTRSRYWGQGTLVTVSS |
| 426 | 51G04 | EVQLVESGGGLVQPGGSLTLSCAASGDSVSLLSMAWYRQAPGKKRELVAGISANGSTSYIDSVKGRFTISRDNAKNSVYLQMNSLRAEDTAVYYCYAYNWTSRYRYWGQGTLVTVSS |
| 427 | 51G10 | EVQLVESGGGLVQPGGSLTLSCAASGSDVWYLSLAWYRQAPGKKRELVAGISDDGSRHYIESVKGRFTISRDNAKNSVYLQMNSLRAEDTAVYYCYAYSWKTRFPYWGQGTLVTVSS |
| 428 | 51H04 | EVQLVESGGGLVQPGGSLTLSCAASKSAVAFLSIAWYRQAPGKKRELVAGISPDGSTVYIESVKGRFTISRDNAKNSVYLQMNSLRAEDTAVYYCYAYSWTTRYPYWGQGTLVTVSS |
| 429 | 51H05 | EVQLVESGGGLVQPGGSLTLSCAASFSAVAYLSMAWYRQAPGKKRELVAGISDDGSTVYVDSVKGRFTISRDNAKNSVYLQMNSLRAEDTAVYYCYAYEWTNALPYWGQGTLVTVSS |
| 430 | 52B01 | EVQLVESGGGLVQPGGSLTLSCAASVYSVYDLSTAWYRQAPGKKRELVAGISDDGSTVYFDSVKGRFTISRDNAKNSVYLQMNSLRAEDTAVYYCYAYSWITRSPYWGQGTLVTVSS |
| 431 | 52C04 | EVQLVESGGGLVQPGGSLTLSCAASGDSVSFLSMAWYRQAPGKKRELVAGISDEGSTVYIGSVKGRFTISRDNAKNSVYLQMNSLRAEDTAVYYCYAYSWTTRRQYWGQGTLVTVSS |
| 432 | 52D04 | EVQLVESGGGLVQPGGSLTLSCAASSSSVSLLSLAWYRQAPGKKRELVAGISDDGSIVYMDSVKGRFTISRDNAKNSVYLQMNSLRAEDTAVYYCYAYSWITRSPYWGQGTLVTVSS |
| 433 | 53A04 | EVQLVESGGGLVQPGGSLTLSCAASADSVSFLSIAWYRQAPGKKRELVAGISDDGSKHYFDSVKGRFTISRDNAKNSVYLQMNSLRAEDTAVYYCYARWEESRQYWGQGTLVTVSS |
| 434 | 53A05 | EVQLVESGGGLVQPGGSLTLSCAASASSVTLLSIAWYRQAPGKKRELVAGISTDGSTDYLHSVKGRFTISRDNAKNSVYLQMNSLRAEDTAVYYCYAYTWTTRLPYWGQGTLVTVTS |
| 435 | 53A09 | EVQLVESGGGLVQPGGSLTLSCAASADSVSFLSIAWYRQAPGKKRELVAGISDDGSKHYFDSVKGRFTISRDNAKNSVYLQMNSLRAEDTAVYYCYARWEESRQYWGQGTLVTVSS |
| 436 | 53B05 | EVQLVESGGGLVQPGGSLTLSCAASGTSVWLLSMAWYRQAPGKKRELVAGISYDGSTVYVESVKGRFTISRDNAKNSVYLQMNSLRAEDTAVYYCYAYSWTTRQPYWGQGTLVTVSS |
| 437 | 53B06 | EVQLVESGGGLVQPGGSLTLSCAASGSSVSILSIAWYRQAPGKKRELVAGISDDGSTVYIDSVKGRFTISRDNAKNSVYLQMNSLRAEDTAVYYCYAVWGTRLPYWGQGTLVTVSS |

| | | -continued |
|---|---|---|
| 438 | 53C03 | EVQLVESGGGLVQPGGSLTLSCAASGTAVSNLSIAWYRQAPGKKRELVAGISDDGSTVYVD SVKGRFTISRDNAKNSVYLQMNSLRAEDTAVYYCYAYEWTNALPYWGQGTLVTVSS |
| 439 | 53C04 | EVQLVESGGGLVQPGGSLTLSCAASGSAVSMLSLAWYRQAPGKKRELVAGISDDGSQVYID SVKGRFTISRDNAKNSVYLQMNSLRAEDTAVYYCYAYRWEDALTYWGQGTLVTVSS |
| 440 | 53H03 | EVQLVESGGGLVQPGGSLTLSCAASGMTVFFLSMAWYRQAPGKKRELVAGISVDGSTVYSD SVKGRFTISRDNAKNSVYLQMNSLRAEDTAVYYCYAYSWTTRYPYWGQGTLVTVSS |
| 441 | 53H04 | EVQLVESGGGLVQPGGSLTLSCAASQYSVTFLSVAWYRQAPGKKRELVAGISDDGSNVYID SVKGRFTISRDNAKNSVYLQMNSLRAEDTAVYYCYAYSWIDSLRYWGQGTLVTVSS |
| 442 | 54B05 | EVQLVESGGGLVQPGGSLTLSCAASGETVSFLSLAWYRQAPGKKRELVAGISTDGSTVYFV SVKGRFTISRDNAKNSVYLQMNSLRAEDTAVYYCYAYSWTTPRAYWGQGTLVTVSS |

| SEQ ID NO. | name | CDR1 |
|---|---|---|
| 443 | DL1 | GSIFSIASMG |
| 444 | DL74 | GSIFSIASMG |
| 445 | DL31 | GSIFSIASMA |
| 446 | DL3 | ESIFSINVMA |
| 447 | DL80 | GSSFSITSMA |
| 448 | DL18 | SSIFSISSMS |
| 449 | DL94 | SSIFSISSMS |
| 450 | DL17 | GSTLNIKIMA |
| 451 | DL46 | GSTLNIKIMA |
| 452 | DL15 | GSTFNIKTMA |
| 453 | DL26 | GSTFNIKLMA |
| 454 | DL83 | GSTFNFKIMA |
| 455 | DL5 | GFMFSSYSMS |
| 456 | DL22 | GFMFSSYSMS |
| 457 | DL85 | GFTFSSHSMS |
| 458 | DL69 | GSSFSHNTMG |
| 459 | DL27 | GGRFSYATMG |
| 460 | DL51 | GSRFSYATMG |
| 461 | DL54 | GSTFTSNVMG |
| 462 | DL11 | GSSVSFLSMA |
| 463 | DL19 | GSSVSFLSMA |
| 464 | DL68 | GSSVSFLSMA |
| 465 | DL14 | GSSVSFLSMA |
| 466 | DL67 | GSSVSFLSMA |
| 467 | DL56 | GSSVSFLSMA |
| 468 | DL13 | GSSVSFLSMA |
| 469 | DL77 | GSSVSFLSIA |
| 470 | DL79 | GSSVSFLSMA |
| 471 | DL20 | GSSVSFLSMA |
| 472 | DL41 | GSSVSFLSMA |
| 473 | DL59 | GSSVSFLSMA |

-continued

| | | |
|---|---|---|
| 474 | DL16 | GSSVSFLSMA |
| 475 | DL6 | GSSVSFLSMA |
| 476 | DL84 | GFTLDYYAIG |
| 477 | DL2 | GSTSSINAMG |
| 478 | DL43 | GSTSSINAMG |
| 479 | DL92 | GITSSVYSMG |
| 480 | DL10 | GRTSMFNSMG |
| 481 | DL82 | GRTSMVNSMG |
| 482 | DL23 | GSVSMFNSMG |
| 483 | DL42 | GSIFSIAVMG |
| 484 | DL45 | SGIFSDMSMV |
| 485 | DL58 | GSISSIIVMG |
| 486 | DL70 | GSISSIIVMG |
| 487 | DL89 | GSIFTTNSMG |
| 488 | DL38 | GSREISTMG |
| 489 | DL52 | GSREISTMG |
| 490 | DL64 | GSREISTMG |
| 491 | DL33 | GSREISTMG |
| 492 | DL12 | GSIFRGAAMY |
| 493 | DL29 | GSISSFNFMS |
| 494 | DL61 | GTIFTASTMG |
| 495 | DH1 | GSIFSIASMG |
| 496 | DH10 | GRTSMFNSMG |
| 497 | DH11 | GSSVSFLSMA |
| 498 | DH12 | GSIFRGAAMY |
| 499 | DH15 | GSTFNIKTMA |
| 500 | DH17 | GSTLNIKIMA |
| 501 | DH18 | SSIFSISSMS |
| 502 | DH2 | GSTSSINAMG |
| 503 | DH22 | GFMFSSYSMS |
| 504 | DH23 | GSVSMFNSMG |
| 505 | DH27 | GGRFSYATMG |
| 506 | DH29 | GSISSFNFMS |
| 507 | DH3 | ESIFSINVMA |
| 508 | DH38 | GSREISTMG |
| 509 | DH42 | GSIFSIAVMG |
| 510 | DH43 | GSTSSINAMG |
| 511 | DH45 | SGIFSDMSMV |
| 512 | DH5 | GFMFSSYSMS |

-continued

| | | |
|---|---|---|
| 513 | DH51 | GSRFSYATMG |
| 514 | DH54 | GSTFTSNVMG |
| 515 | DH56 | GSSVSFLSMA |
| 516 | DH58 | GSISSIIVMG |
| 517 | DH6 | GSSVSFLSMA |
| 518 | DH61 | GTIFTASTMG |
| 519 | DH67 | GSSVSFLSMA |
| 520 | DH69 | GSSFSHNTMG |
| 521 | DH70 | GSISSIIVMG |
| 522 | DH80 | GSSFSITSMA |
| 523 | DH82 | GRTSMVNSMG |
| 524 | DH83 | GSTFNFKIMA |
| 525 | DH84 | GFTLDYYAIG |
| 526 | DH89 | GSIFTTNSMG |
| 527 | DH92 | GITSSVYSMG |
| 528 | DH94 | SSIFSISSMS |
| 529 | 1A01 | GFTSSINAMG |
| 530 | 1A03 | GSTSSINAMA |
| 531 | 1A04 | GSTSSINAMG |
| 532 | 1A05 | GSPSSINAMG |
| 533 | 1A06 | GSTSSINAMG |
| 534 | 1A07 | GSISSINAMG |
| 535 | 1A09 | GSTSSINAMA |
| 536 | 1A010 | GSTSSINAYG |
| 537 | 1A011 | GSTSSINAIG |
| 538 | 1A012 | GSTSSINAMA |
| 539 | 1B01 | GSTSIINAMG |
| 540 | 1B02 | GSTSSINAMG |
| 541 | 1B03 | GKTSSINAMA |
| 542 | 1B04 | GTTSSINAMG |
| 543 | 1B05 | GSTSSINAMA |
| 544 | 1B07 | GSGSSINAMG |
| 545 | 1B08 | GTTSSINAMG |
| 546 | 1B09 | GSTSSINAMA |
| 547 | 1B010 | GSTSRINAMG |
| 548 | 1B011 | GSTSRINAMG |
| 549 | 1C01 | GSTSSINAMG |
| 550 | 1C02 | GSTSSINAMA |
| 551 | 1C03 | GSTSSINAMA |
| 552 | 1C04 | GNTSSINAMA |

-continued

| | | |
|---|---|---|
| 553 | 1C05 | GSTSSINAMA |
| 554 | 1C06 | GSTSIINAMG |
| 555 | 1C07 | GSTSSINAMA |
| 556 | 1C08 | GSTSRINAMG |
| 557 | 1C010 | GSTSRINAMG |
| 558 | 1C011 | GTTSSINAMG |
| 559 | 1C012 | GITSSINAMG |
| 560 | 1D01 | GSTSDINAMG |
| 561 | 1D02 | GSTSSINAMA |
| 562 | 1D03 | GSTSSINAIG |
| 563 | 1D04 | GSTSSKNAMG |
| 564 | 1D06 | GSTSSINAMG |
| 565 | 1D08 | GLTSSINAMG |
| 566 | 1D09 | GSTSSINAMA |
| 567 | 1D010 | GSTSSNNAMA |
| 568 | 1D011 | GSTSSINAMA |
| 569 | 1D012 | GSTSHINAMG |
| 570 | 1E02 | GQTSSINAMG |
| 571 | 1E04 | GSTSRINGMG |
| 572 | 1E05 | GSTSVINAMA |
| 573 | 1E07 | GSTSSINAMA |
| 574 | 1E08 | GKTSSINAMG |
| 575 | 1E09 | GSTSSINAMA |
| 576 | 1E010 | GSVSSINAMG |
| 577 | 1E011 | GNTSSINAMG |
| 578 | 1E012 | GSTSSTNAMG |
| 579 | 1F01 | GSTSSINAMG |
| 580 | 1F02 | GSTSSINAMA |
| 581 | 1F04 | GGTSSINAMG |
| 582 | 1F05 | GSTRSINAMG |
| 583 | 1F06 | GTTSSINAMG |
| 584 | 1F07 | GSTSSINAMG |
| 585 | 1F08 | GSTSSINAMA |
| 586 | 1F09 | GNTSSINAMG |
| 587 | 1F010 | GSTSRINAMG |
| 588 | 1F011 | GSTSSINAIG |
| 589 | 1F012 | GLTSSINAMG |
| 590 | 1G01 | GSTSSINAMA |
| 591 | 1G04 | GSTSSTNAMG |

-continued

| | | |
|---|---|---|
| 592 | 1G05 | GSTSSINAIG |
| 593 | 1G06 | GSTSSINAIG |
| 594 | 1G07 | GSTSSINAMG |
| 595 | 1G09 | GSTSSINAMG |
| 596 | 1G011 | GSTSSINAMA |
| 597 | 1H01 | GSTSSINAMA |
| 598 | 1H02 | GSKSSINAMG |
| 599 | 1H06 | GTTSSINAMG |
| 600 | 1H07 | GSTSSINAFG |
| 601 | 1H08 | GSTFSINAMG |
| 602 | 1H010 | GSTRSINAMG |
| 603 | 1H011 | GSTSSINAIG |
| 604 | 1H012 | GSTSSINAMG |
| 605 | 2A01 | GSTSSINAMG |
| 606 | 2A03 | GTTSSINAMG |
| 607 | 2A04 | GSTSSINAMA |
| 608 | 2A05 | GRTSSINAMG |
| 609 | 2A06 | GSTSSRNAMG |
| 610 | 2A08 | GSTKSINAMG |
| 611 | 2A09 | GSTSSRNAMG |
| 612 | 2A011 | GSTSSINAIG |
| 613 | 2B01 | GSTSLINAMG |
| 614 | 2B02 | GSTSSINAMA |
| 615 | 2B03 | GSTSSINAMG |
| 616 | 2B05 | GTTSSINAMG |
| 617 | 2B07 | GSTSSINAFG |
| 618 | 2B010 | GSTSSRNAMG |
| 619 | 2B011 | GNTSSINAMG |
| 620 | 2B012 | GTTSSINAMG |
| 621 | 2C01 | GSTASINAMG |
| 622 | 2C02 | GSTSSINAVG |
| 623 | 2C04 | GSTSSRNAMG |
| 624 | 2C06 | GSTNSINAMG |
| 625 | 2C07 | GSTSSINAMA |
| 626 | 2C08 | GSTSRINAMG |
| 627 | 2C09 | GSTSNINAMG |
| 628 | 2C010 | GSTSKINAMG |
| 629 | 2D02 | GSTSSINALG |
| 630 | 2D03 | GKTSSINAMG |
| 631 | 2D04 | GSTSSINAVG |

-continued

| | | |
|---|---|---|
| 632 | 2D05 | GSTSRINAMG |
| 633 | 2D06 | GSTSSINAMG |
| 634 | 2D07 | GSTSSINAVG |
| 635 | 2D09 | GTTSSINAMG |
| 636 | 2D010 | GSTSSINAMG |
| 637 | 2D011 | GTTSSINAMG |
| 638 | 2D012 | GKTSSINAMG |
| 639 | 2E01 | GSTSSINAMG |
| 640 | 2E02 | GSTSAINAMG |
| 641 | 2E05 | GSPSSINAYG |
| 642 | 2E06 | GSTSSINAMG |
| 643 | 2E08 | GSRSSINAMG |
| 644 | 2E09 | GSVSSINAMG |
| 645 | 2E010 | GSTSSINAMA |
| 646 | 2E011 | GSTSSINAIG |
| 647 | 2F01 | GSTSSINAMG |
| 648 | 2F02 | GSTSSINAVG |
| 649 | 2F03 | GSTSSINAMA |
| 650 | 2F06 | GSTSSINAYG |
| 651 | 2F07 | GSTSSINAVG |
| 652 | 2F08 | GSKSSINAMG |
| 653 | 2F09 | GSTSSINAMA |
| 654 | 2F11 | GSVSSINAMG |
| 655 | 2G03 | GSTSSINAMG |
| 656 | 2G04 | GSTSSINAMG |
| 657 | 2G07 | GSTSSINAMA |
| 658 | 2G08 | GSTSYINAMG |
| 659 | 2G09 | GSTSSINAMG |
| 660 | 2G011 | GSTSSINAMG |
| 661 | 2H010 | GSTSSINAMG |
| 662 | 2H011 | GSTSRINAMG |
| 663 | 2H02 | GSTSSINAMA |
| 664 | 2H03 | GSTSSINAMA |
| 665 | 2H04 | GSTSSINAMG |
| 666 | 2H06 | GSTSTINAMG |
| 667 | 2H07 | GSTSSINAVG |
| 668 | 2H08 | GSTSSINAMG |
| 669 | 2E05-M106Y | GSPSSINAYG |
| 670 | 2E05-M106Q | GSPSSINAYG |

-continued

| | | |
|---|---|---|
| 671 | 3A01 | GSSVKFLSMA |
| 672 | 3A02 | GSSVSFLSLA |
| 673 | 3A03 | GSRVSFLSMA |
| 674 | 3A04 | GSQVSFLSMA |
| 675 | 3A05 | GSSVSFLSMA |
| 676 | 3A06 | GSKVSFLSMA |
| 677 | 3A08 | GSSVGFLSMA |
| 678 | 3A09 | GSSVSFLSMA |
| 679 | 3A010 | GSRVSFLSMA |
| 680 | 3A011 | GSSVSFLSLA |
| 681 | 3B01 | GSSVSFLSMA |
| 682 | 3B02 | GSSVQFLSMA |
| 683 | 3B04 | GSNVSFLSMA |
| 684 | 3B05 | GSSVKFLSMA |
| 685 | 3B06 | GKSVSFLSMA |
| 686 | 3B07 | GSRVSFLSMA |
| 687 | 3B09 | GSHVSFLSMA |
| 688 | 3B010 | GSSVSFLSMA |
| 689 | 3B011 | GSSVSFLSMA |
| 690 | 3C01 | GSSVRFLSMA |
| 691 | 3C02 | GSSVRFLSMA |
| 692 | 3C03 | GSSVRFLSMA |
| 693 | 3C04 | GSHVSFLSMA |
| 694 | 3C05 | GTSVSFLSMA |
| 695 | 3C06 | GTSVSFLSIA |
| 696 | 3C08 | GSSVKFLSMA |
| 697 | 3C09 | GSSVSFLSMA |
| 698 | 3C011 | GSSVRFLSMA |
| 699 | 3D01 | GSSVSFLSMA |
| 700 | 3D02 | GSSVRFLSMA |
| 701 | 3D03 | GSSVVFLSMA |
| 702 | 3D05 | GSSVRFLSMA |
| 703 | 3D07 | GSSVRFLSMA |
| 704 | 3D08 | GSSVRFLSMA |
| 705 | 3D09 | GSSVSRLSMA |
| 706 | 3D010 | GSSKSFLSMA |
| 707 | 3D011 | GSSVSRLSMA |
| 708 | 3E01 | GSSVKFLSMA |
| 709 | 3E02 | GSGVRFLSMA |
| 710 | 3E03 | GSSVRFLSMA |

| | | |
|---|---|---|
| 711 | 3E04 | GSSVHFLSMA |
| 712 | 3E09 | GSSVRFLSMA |
| 713 | 3E011 | GSKVSFLSMA |
| 714 | 3F03 | GSSVSFLSMA |
| 715 | 3F05 | GSKVSFLSMA |
| 716 | 3F06 | GSRVSFLSMA |
| 717 | 3F08 | GSRVSFLSMA |
| 718 | 3F09 | GSSVRFLSMA |
| 719 | 3F010 | YSSVSRLSMA |
| 720 | 3F011 | GSSVSFLSMA |
| 721 | 3G01 | GSSVSFLSMA |
| 722 | 3G02 | GSSVSFLSMA |
| 723 | 3G04 | GTSVSFLSMA |
| 724 | 3G06 | GSSVKFLSMA |
| 725 | 3G07 | GSSVSFLSMA |
| 726 | 3G08 | GSRVSFLSMA |
| 727 | 3G09 | GSSVSVLSMA |
| 728 | 3G010 | GSSVSFLSMA |
| 729 | 3G011 | GSRVSFLSMA |
| 730 | 3H01 | GSSVKFLSMA |
| 731 | 3H03 | GSSVRFLSMA |
| 732 | 3H06 | GSSVSQLSMA |
| 733 | 3H07 | GSRVSFLSMA |
| 734 | 3H09 | KSSVSFLSMA |
| 735 | 3H010 | GSSVSFLSMA |
| 736 | 3H011 | GSSVKFLSMA |
| 737 | 4A01 | GSSVRFLSMA |
| 738 | 4A02 | GSSVRFLSMA |
| 739 | 4A04 | GSRVSFLSMA |
| 740 | 4A05 | GSSVSFLSLA |
| 741 | 4A06 | GSSVRFLSMA |
| 742 | 4A07 | GSKVSFLSMA |
| 743 | 4A08 | GSSVSFLSMA |
| 744 | 4A010 | GSSVRFLSMA |
| 745 | 4A011 | GSKVSFLSMA |
| 746 | 4A09 | GSSVKFLSMA |
| 747 | 4B01 | GSSVKFLSMA |
| 748 | 4B02 | GSRVSFLSMA |
| 749 | 4B04 | GSSVLFLSMA |

| | | -continued |
|---|---|---|
| 750 | 4B05 | GSRVSFLSMA |
| 751 | 4B06 | GSRVSFLSMA |
| 752 | 4B07 | GSSVGFLSMA |
| 753 | 4B08 | GSSVSFMSMA |
| 754 | 4B09 | GSSVSFLSMA |
| 755 | 4B011 | GSSVTFLSMA |
| 756 | 4C01 | GSSVRFLSMA |
| 757 | 4C02 | GSKVSFLSMA |
| 758 | 4C03 | GSKVSFMSMA |
| 759 | 4C05 | GSSVSNLSMA |
| 760 | 4C06 | NSSVSKLSMA |
| 761 | 4C07 | GSKVSFLSMA |
| 762 | 4C08 | GSQVSFLSMA |
| 763 | 4C010 | GSKVSFMSMA |
| 764 | 4C011 | GSRVSFLSMA |
| 765 | 4D01 | GSSVRFLSMA |
| 766 | 4D02 | GSKVSFLSMA |
| 767 | 4D03 | GSSVRFLSMA |
| 768 | 4D04 | GSSVSFLSIA |
| 769 | 4D05 | GSSSSFLSMA |
| 770 | 4D06 | GSSVKFLSMA |
| 771 | 4D08 | GSSVNFLSMA |
| 772 | 4D09 | GSSVKFLSMA |
| 773 | 4D010 | GSSVSFLSMA |
| 774 | 4D011 | GSSVRFLSMA |
| 775 | 4E01 | GSSVSFLSVA |
| 776 | 4E02 | GSQVSFLSMA |
| 777 | 4E06 | GTSVSFLSMA |
| 778 | 4E07 | GSRVSFLSMA |
| 779 | 4E08 | GSSVKFLSMA |
| 780 | 4E09 | GSSVSFLSSA |
| 781 | 4E010 | GSSVKFLSMA |
| 782 | 4E011 | GSSVSFLSMA |
| 783 | 4F02 | GSTVSFLSMA |
| 784 | 4F03 | GSSVQFLSMA |
| 785 | 4F04 | RSSVSFLSMA |
| 786 | 4F08 | GSKVSFLSMA |
| 787 | 4F09 | GSRVSFLSMA |
| 788 | 4F010 | GSSVSFLSMA |
| 789 | 4F011 | GSKVSFLSMA |

| | | |
|---|---|---|
| 790 | 4G01 | GSSVRFLSMA |
| 791 | 4G02 | GSSVKFLSMA |
| 792 | 4G03 | GSSVKFLSMA |
| 793 | 4G05 | GSSVSILSMA |
| 794 | 4G07 | GSSVSFLSVA |
| 795 | 4G08 | GSSVRFLSMA |
| 796 | 4G09 | GSRVSFLSMA |
| 797 | 4G010 | GHSVSFLSMA |
| 798 | 4G011 | GSSVRFLSMA |
| 799 | 4H01 | GSSVSFLSMA |
| 800 | 4H03 | GSRVSFLSMA |
| 801 | 4H04 | GSSVKFLSMA |
| 802 | 4H05 | GSSVSRLSMA |
| 803 | 4H06 | GRSVSFLSMA |
| 804 | 4H07 | GRSVSFLSMA |
| 805 | 4H08 | GSSVKFLSMA |
| 806 | 4H09 | GSSVSKLSMA |
| 807 | 4H011 | GSSVSRLSMA |
| 808 | 4D09-M34L | GSSVKFLSLA |
| 809 | 4H11-M34L | GSSVSRLSLA |
| 810 | 41B11 | GTSSSINAMG |
| 811 | 41C02 | GTTSSINAIG |
| 812 | 41D01 | GSTSSINAMA |
| 813 | 41D02 | GQTYRVNAFG |
| 814 | 41D03 | GSTSSINAMA |
| 815 | 41D07 | GSASLTNATG |
| 816 | 41E01 | GYPSLNNAMG |
| 817 | 41E02 | GSSSTINAIG |
| 818 | 41F07 | GSTSYINAMG |
| 819 | 41G01 | GSTSSVNALG |
| 820 | 42A03 | GSTSLSNAVG |
| 821 | 42A06 | GSTSSTNAIG |
| 822 | 42A07 | GLTSTINAMG |
| 823 | 42A08 | GVSPSKNAIG |
| 824 | 42A11 | GSTSSINAVG |
| 825 | 42B06 | GSTTMNNAMA |
| 826 | 42B10 | GSTSKINAIG |
| 827 | 42C01 | GQTTALNAMG |
| 828 | 42C03 | GATSSINAIG |

| | | -continued |
|---|---|---|
| 829 | 42C07 | GSTSTINAMG |
| 830 | 42C08 | GSTSSINAMG |
| 831 | 42C10 | GSTSLVNAMG |
| 832 | 42C11 | GSTSLNNAIG |
| 833 | 42D05 | GSTSPVNAMA |
| 834 | 42D06 | GTTSSMNAIG |
| 835 | 42D07 | GETSSINAMA |
| 836 | 42D08 | GSTSTINAIG |
| 837 | 42E01 | GSTYSMNAMG |
| 838 | 42E02 | GSPSSINAYG |
| 839 | 42E05 | GSTSTINAIG |
| 840 | 42E06 | GSTSSINAIG |
| 841 | 42E07 | GSISSINAMG |
| 842 | 42F01 | GSTQVNNAMA |
| 843 | 42F08 | GSTASFNAMA |
| 844 | 42F10 | GSPLSINAIG |
| 845 | 42G05 | GSTTFINAIG |
| 846 | 42G07 | GSTSSINAIG |
| 847 | 42H05 | GETDTINAVG |
| 848 | 42H08 | GSTSPINAIG |
| 849 | 42H11 | GSITSSNAMG |
| 850 | 51A01 | RYSVSNLSMA |
| 851 | 51A02 | MSTVSVLSMA |
| 852 | 51A03 | DSYVSLLSMA |
| 853 | 51A05 | DSAVSVLSIA |
| 854 | 51B01 | HSSVTSLSLA |
| 855 | 51B04 | DSVVKFLSMA |
| 856 | 51B11 | DPSVWNLSMA |
| 857 | 51C02 | GTSVMLLSLA |
| 858 | 51D01 | SSPVSNLSLA |
| 859 | 51D03 | WRSVLLLSVA |
| 860 | 51E02 | SSSVQYLSMA |
| 861 | 51E03 | GTSVSLLSLA |
| 862 | 51E05 | LSSVSNLSIA |
| 863 | 51F01 | MYSVSFLSMA |
| 864 | 51F02 | KSSVSHLSLA |
| 865 | 51F03 | YTSVLDLSIA |
| 866 | 51F04 | MSDVSFLSMA |
| 867 | 51G02 | ESSVSFLSSA |
| 868 | 51G04 | GDSVSLLSMA |

| | | |
|---|---|---|
| 869 | 51G10 | GSDVWYLSLA |
| 870 | 51H04 | KSAVAFLSIA |
| 871 | 51H05 | FSAVAYLSMA |
| 872 | 52B01 | VYSVYDLSTA |
| 873 | 52C04 | GDSVSFLSMA |
| 874 | 52D04 | SSSVSLLSLA |
| 875 | 53A04 | ADSVSFLSIA |
| 876 | 53A05 | ASSVTLLSIA |
| 877 | 53A09 | ADSVSFLSIA |
| 878 | 53B05 | GTSVWLLSMA |
| 879 | 53B06 | GSSVSILSIA |
| 880 | 53C03 | GTAVSNLSIA |
| 881 | 53C04 | GSAVSMLSLA |
| 882 | 53H03 | GMTVFFLSMA |
| 883 | 53H04 | QYSVTFLSVA |
| 884 | 54B05 | GETVSFLSLA |

| SEQ. ID NO. | name | CDR2 |
|---|---|---|
| 885 | DL1 | VITSFSSTNYADSVKG |
| 886 | DL74 | VITSFSSTNYADSVKG |
| 887 | DL31 | AITSFSSTNYADSVKG |
| 888 | DL3 | RITSGGSTNYADSVKG |
| 889 | DL80 | AITSFGSTNYADSVKD |
| 890 | DL18 | AITTFDYTNYADSVKG |
| 891 | DL94 | AITSFGSTNYADSVKG |
| 892 | DL17 | TLTSGGNTNYADSVKG |
| 893 | DL46 | TLTSGGNTNYADSVKG |
| 894 | DL15 | TLTSGGNTNYADSVKG |
| 895 | DL26 | TLTSGGNTNYADSVKG |
| 896 | DL83 | SLTSEGLTNYRDSVKG |
| 897 | DL5 | AITTWGSTNYADSVKG |
| 898 | DL22 | AITSYGSTNYADSVKG |
| 899 | DL85 | AITTYGSTNYIDSVKG |
| 900 | DL69 | RITTFGTTNYADSVKG |
| 901 | DL27 | RITSSGFSTNYADSVKG |
| 902 | DL51 | RITSSGFSTNYADSVKG |
| 903 | DL54 | NMHSGGSTNYADSVKG |
| 904 | DL11 | GISVDGSTNYADSVKG |
| 905 | DL19 | GISVDGSTNYADSVKG |
| 906 | DL68 | GISVDGSTNYADSVKG |

| | | |
|---|---|---|
| 907 | DL14 | GISVDGSTNYADSVKG |
| 908 | DL67 | GISVDGSTNYADSVKG |
| 909 | DL56 | GISTDGSTNYVDSVKG |
| 910 | DL13 | GISTDGTTNYVDSVKD |
| 911 | DL77 | GISTDGTTNYVDSVKD |
| 912 | DL79 | GISTDGTTNYVDSVKD |
| 913 | DL20 | GISTDGSTNYADSVKG |
| 914 | DL41 | GISTDGSTNYADSVKG |
| 915 | DL59 | GISTDGSTNYADSVKG |
| 916 | DL16 | GISSDGSTNYVDSVKG |
| 917 | DL6 | GISADGSTDYIDSVKG |
| 918 | DL84 | GISSDGSTHYVDSVKG |
| 919 | DL2 | GISSDGSKNYADSVKG |
| 920 | DL43 | GISSDGSKVYADSVKG |
| 921 | DL92 | GSSSDGSTHYVDSVRG |
| 922 | DL10 | IIRSGGSSNYADTVKG |
| 923 | DL82 | LITSGGSSNYADTVKG |
| 924 | DL23 | IITSGGSSNYADTVKG |
| 925 | DL42 | TIFDGSYTNYADSVKG |
| 926 | DL45 | SITTFGSTNYADPVKG |
| 927 | DL58 | TITRDGTRNYADSLKG |
| 928 | DL70 | TISRGGTRTYADSVKG |
| 929 | DL89 | LIGSAGSTKYADSVKG |
| 930 | DL38 | RITSGGITKYADSVKG |
| 931 | DL52 | RITSGGITKYADSVKG |
| 932 | DL64 | RITSGGITKYADSVKG |
| 933 | DL33 | RITSGGITKYADSVKG |
| 934 | DL12 | AITTSGNTSYADSVKG |
| 935 | DL29 | VITRGGATNYADSVKG |
| 936 | DL61 | SIAGDGRTNYAESTEG |
| 937 | DH1 | VITSFSSTNYADSVKG |
| 938 | DH10 | IIRSGGSSNYADTVKG |
| 939 | DH11 | GISVDGSTNYADSVKG |
| 940 | DH12 | AITTSGNTSYADSVKG |
| 941 | DH15 | TLTSGGNTNYADSVKG |
| 942 | DH17 | TLTSGGNTNYADSVKG |
| 943 | DH18 | AITTFDYTNYADSVKG |
| 944 | DH2 | GISSDGSKNYADSVKG |
| 945 | DH22 | AITSYGSTNYADSVKG |

-continued

| 946 | DH23 | IITSGGSSNYADTVKG |
| 947 | DH27 | RITSSGFSTNYADSVKG |
| 948 | DH29 | VITRGGATNYADSVKG |
| 949 | DH3 | RITSGGSTNYADSVKG |
| 950 | DH38 | RITSGGITKYADSVKG |
| 951 | DH42 | TIFDGSYTNYADSVKG |
| 952 | DH43 | GISSDGSKVYADSVKG |
| 953 | DH45 | SITTFGSTNYADPVKG |
| 954 | DH5 | AITTWGSTNYADSVKG |
| 955 | DH51 | RITSSGFSTNYADSVKG |
| 956 | DH54 | NMHSGGSTNYADSVKG |
| 957 | DH56 | GISTDGSTNYVDSVKG |
| 958 | DH58 | TITRDGTRNYADSLKG |
| 959 | DH6 | GISADGSTDYIDSVKG |
| 960 | DH61 | SIAGDGRTNYAESTEG |
| 961 | DH67 | GISVDGSTNYADSVKG |
| 962 | DH69 | RITTFGTTNYADSVKG |
| 963 | DH70 | TISRGGTRTYADSVKG |
| 964 | DH80 | AITSFGSTNYADSVKD |
| 965 | DH82 | LITSGGSSNYADTVKG |
| 966 | DH83 | SLTSEGLTNYRDSVKG |
| 967 | DH84 | GISSDGSTHYVDSVKG |
| 968 | DH89 | LIGSAGSTKYADSVKG |
| 969 | DH92 | GSSSDGSTHYVDSVRG |
| 970 | DH94 | AITSFGSTNYADSVKG |
| 971 | 1A01 | GISSDGSFVYADSVKG |
| 972 | 1A03 | GISSDGSKVYADSVKG |
| 973 | 1A04 | GISSDGSKVYEDSVKG |
| 974 | 1A05 | GISSDGSKVYADSVKG |
| 975 | 1A06 | GISSDGSSVYADSVKG |
| 976 | 1A07 | GISSDGSKVYADSVKG |
| 977 | 1A09 | GISSDGSKLYADSVKG |
| 978 | 1A010 | GISSDGSKVYADSVKG |
| 979 | 1A011 | GISSDGSKVYIDSVKG |
| 980 | 1A012 | GISSDGSKVYSDSVKG |
| 981 | 1B01 | GISSDGSKVIADSVKG |
| 982 | 1B02 | GISSDGSKIYADSVKG |
| 983 | 1B03 | GISSDGSKVYTDSVKG |
| 984 | 1B04 | GISSDGSLVYADSVKG |
| 985 | 1B05 | GISSDGSKVYADSVKG |

-continued

| | | |
|---|---|---|
| 986 | 1B07 | GISSDGSKVYSDSVKG |
| 987 | 1B08 | GISSDGSKVYVDSVKG |
| 988 | 1B09 | GISSDGSKVYVDSVKG |
| 989 | 1B010 | GISSDGSKVYADSVKG |
| 990 | 1B011 | GISSDGSKVYADSVKG |
| 991 | 1C01 | GISSDGSKVYRDSVKG |
| 992 | 1C02 | GISSDGSKVYSDSVKG |
| 993 | 1C03 | GISSDNSKVYADSVKG |
| 994 | 1C04 | GISSDGSKVYADSVKG |
| 995 | 1C05 | GISSDGSKVYADSVKG |
| 996 | 1C06 | GISSDGSKVYEDSVKG |
| 997 | 1C07 | GISSDGSKVYADSVKG |
| 998 | 1C08 | GISSDGSKVYAVSVKG |
| 999 | 1C010 | GVSSDGSKVYADSVKG |
| 1000 | 1C011 | GISSDGSKVYEDSVKG |
| 1001 | 1C012 | GISSDGSKVYAGSVKG |
| 1002 | 1D01 | GISSDKSKVYADSVKG |
| 1003 | 1D02 | GISSNGSKVYADSVKG |
| 1004 | 1D03 | GISSDGSKVLADSVKG |
| 1005 | 1D04 | GISSDGSKVYADSVKG |
| 1006 | 1D06 | GISSDNSKVYADSVKG |
| 1007 | 1D08 | GISSDGSKVYADSVKG |
| 1008 | 1D09 | GISSDGSKVYTDSVKG |
| 1009 | 1D010 | GISSDGSKVYTDSVKG |
| 1010 | 1D011 | GISSDNSKVYADSVKG |
| 1011 | 1D012 | GISSDGSRVYADSVKG |
| 1012 | 1E02 | GISSDGSQVYADSVKG |
| 1013 | 1E04 | GISSDGSKAYADSVKG |
| 1014 | 1E05 | GISSDGSKVYAKSAKG |
| 1015 | 1E07 | GISSDGSKVYNDSVKG |
| 1016 | 1E08 | GISSDGSKVIADSVKG |
| 1017 | 1E09 | GISSDGSKVYTDSVKG |
| 1018 | 1E010 | GISSDGSKVYIDSVKG |
| 1019 | 1E011 | GISSDGSKVYYDSVKG |
| 1020 | 1E012 | GISSDGSKVYVDSVKG |
| 1021 | 1F01 | GISSDGSKVYGDSVKG |
| 1022 | 1F02 | GISSDQSKVYADSAKG |
| 1023 | 1F04 | GISSDGSKVYSDSVKG |
| 1024 | 1F05 | GISSDGSKVYADSVKG |

-continued

| | | |
|---|---|---|
| 1025 | 1F06 | GISSDGSKVIADSVKG |
| 1026 | 1F07 | GISSDGSKVDADSVKG |
| 1027 | 1F08 | GISSDGSKVYKDSVKG |
| 1028 | 1F09 | GISSNGSKVYADSVKG |
| 1029 | 1F010 | GISSDGSKVYKDSVKG |
| 1030 | 1F011 | GISSDGSKVYADSVKG |
| 1031 | 1F012 | GISSDGSKVYQDSVKG |
| 1032 | 1G01 | GISSDGSKVYAESVKG |
| 1033 | 1G04 | GISSDGSKVLADSVKG |
| 1034 | 1G05 | GISSDGSKYYADSVKG |
| 1035 | 1G06 | GISSDGSKVYAVSVKG |
| 1036 | 1G07 | GISSDGSKVVADSVKG |
| 1037 | 1G09 | GISSDGSKVYADSVKG |
| 1038 | 1G011 | GISSDGSKVYADSVKG |
| 1039 | 1H01 | GISSDNSKVYADSVKG |
| 1040 | 1H02 | GISSDGSKVYAQSVKG |
| 1041 | 1H06 | GISSDGSKVYVDSVKG |
| 1042 | 1H07 | GISSDGSKVYSDSVKG |
| 1043 | 1H08 | GISSDGSKVLADSVKG |
| 1044 | 1H010 | GISSDGSKVYNDSVKG |
| 1045 | 1H011 | GISSDGSKVYNDSVKG |
| 1046 | 1H012 | GISSDGSKVYVDSVKG |
| 1047 | 2A01 | GISSDGSKVVADSVKG |
| 1048 | 2A03 | GISSDGSKVYGDSVKG |
| 1049 | 2A04 | GISSDGSKVYTDSVKG |
| 1050 | 2A05 | GISSDGSKVYNDSVKG |
| 1051 | 2A06 | GISSDGSKVTADSVKG |
| 1052 | 2A08 | GISSDGSKVYRDSVKG |
| 1053 | 2A09 | GISSNGSKVYSDSVKG |
| 1054 | 2A011 | GISSDGSKVYSDSVKG |
| 1055 | 2B01 | GISSDGSKVYADSVKG |
| 1056 | 2B02 | GISSDGSKVYADSVKG |
| 1057 | 2B03 | GISSDGSLVYADSVKG |
| 1058 | 2B05 | GISSDGTKVYADSVKG |
| 1059 | 2B07 | GISSDGSKVYADSVKG |
| 1060 | 2B010 | GISSDGSKLYLDSVKG |
| 1061 | 2B011 | GISSDGSRVYADSVKG |
| 1062 | 2B012 | GISSDGSKVYNDSVKG |
| 1063 | 2C01 | GISSDGSKVYADSVKG |
| 1064 | 2C02 | GISSDGSKVYVDSVKG |

-continued

| 1065 | 2C04 | GISSDGSKLYADSVKG |
| 1066 | 2C06 | GISSDGSKVYKDSVKG |
| 1067 | 2C07 | GISSDGSKVYADSVKG |
| 1068 | 2C08 | GISSDGSKVYQDSVKG |
| 1069 | 2C09 | GISSDGTKIYADSAKV |
| 1070 | 2C010 | GISSDRSKVYADSVKG |
| 1071 | 2D02 | GISSDGSLVYADSVKG |
| 1072 | 2D03 | GISSDGSKVYADSVKG |
| 1073 | 2D04 | GISSDGSKVYRDSVKG |
| 1074 | 2D05 | GISSDGSKVYADSVKG |
| 1075 | 2D06 | GISSDGSKVYSDSVKG |
| 1076 | 2D07 | GISSDGTKVYRDSVKG |
| 1077 | 2D09 | GISSDGSKVYNDSVKG |
| 1078 | 2D010 | GISSDGSKVYADSVKG |
| 1079 | 2D011 | GISSDGSKVYADSVKG |
| 1080 | 2D012 | GISSDGSKVYTDSVKG |
| 1081 | 2E01 | GISPDGTKAYADSAKV |
| 1082 | 2E02 | GISSDGSKVYVDSVKG |
| 1083 | 2E05 | GISSDGSKVYSDSVKG |
| 1084 | 2E06 | GISSDGSKVYASSVKG |
| 1085 | 2E08 | GISADGSKVYADSVKG |
| 1086 | 2E09 | GISSDGSKVYASSAKG |
| 1087 | 2E010 | GISSDGSKVYADSVKG |
| 1088 | 2E011 | GISSDGSSVYADSVKG |
| 1089 | 2F01 | GISSDGSKVYSDSVKG |
| 1090 | 2F02 | GISSDGSKVYAGSVKG |
| 1091 | 2F03 | GISSDNSKVYADSVKG |
| 1092 | 2F06 | GISSDGSAVYADSVKG |
| 1093 | 2F07 | GISSDGSSVYADSVKG |
| 1094 | 2F08 | GISSNGTKVYADSAKV |
| 1095 | 2F09 | GISSDGSKLYADSVKG |
| 1096 | 2F11 | GISSDGSKVYKDSVKG |
| 1097 | 2G03 | GISSDGSLVYADSVKG |
| 1098 | 2G04 | GISSDGSLVYADSVKG |
| 1099 | 2G07 | GISSDGSKVYADSVKG |
| 1100 | 2G08 | GISSDGSKVYADSVKG |
| 1101 | 2G09 | GVSSDGSKVYADSVKG |
| 1102 | 2G011 | GISRDGSKVYADSVKG |
| 1103 | 2H010 | GISSDGSKLYADSVKG |

-continued

| 1104 | 2H011 | GISSDGSKVYADSVKG |
|---|---|---|
| 1105 | 2H02 | GISSDGSKVYADSVKG |
| 1106 | 2H03 | GISSDGSKVYADSVKG |
| 1107 | 2H04 | GISSDTSKVYADSVKG |
| 1108 | 2H06 | GISSDGSKVYADSVKG |
| 1109 | 2H07 | GISSDGSTVYADSVKG |
| 1110 | 2H08 | GISKDGSKVYADSAKG |
| 1111 | 2E05-M106Y | GISSDGSKVYSDSVKG |
| 1112 | 2E05-M106Q | GISSDGSKVYSDSVKG |
| 1113 | 3A01 | GISADGSTDYIDSVKG |
| 1114 | 3A02 | GISADGSTAYIDSVKG |
| 1115 | 3A03 | GISRDGSTDYIDSVKG |
| 1116 | 3A04 | GISRDGSTDYIDSVKG |
| 1117 | 3A05 | GISEAGSTDYIDSVKG |
| 1118 | 3A06 | GISADGSTDYVDSVKG |
| 1119 | 3A08 | GISADGSTDYIRSVKG |
| 1120 | 3A09 | GISADGSVDYIDSVKG |
| 1121 | 3A010 | GISADGSTLYIDSVKG |
| 1122 | 3A011 | GISTDGSTDYIDSVKG |
| 1123 | 3B01 | GISGDGSTDYIDSVKG |
| 1124 | 3B02 | GISADGSTDYINSVKG |
| 1125 | 3B04 | GISARGSTDYIDSVKG |
| 1126 | 3B05 | GISADGSTTYIDSVKG |
| 1127 | 3B06 | GISKDGSTDYIDSVKG |
| 1128 | 3B07 | GISADGSTTYIDSVKG |
| 1129 | 3B09 | GISANGSTDYIDSVKG |
| 1130 | 3B010 | GISRDGSTDYIDSVKG |
| 1131 | 3B011 | GISADGSADYIDSVKG |
| 1132 | 3C01 | GISAHGSTDYIDSVKG |
| 1133 | 3C02 | GISADGSTIYIDSVKG |
| 1134 | 3C03 | GISRDGSTVYIDSVKG |
| 1135 | 3C04 | GISADGPTDYIDSVKG |
| 1136 | 3C05 | GISADGSTTYIDSVKG |
| 1137 | 3C06 | GISADGSTDYIASVKG |
| 1138 | 3C08 | GISLDGSTDYIDSVKG |
| 1139 | 3C09 | GISADGSTIYIDSVKG |
| 1140 | 3C011 | GISAHGSTDYIDSVKG |
| 1141 | 3D01 | GISRDGSTDYIDSVKG |
| 1142 | 3D02 | GISRDGSTDYIDSVKG |

-continued

| 1143 | 3D03 | GISADGSMDYIDSVKG |
| 1144 | 3D05 | GISADGSTDYIDSVKG |
| 1145 | 3D07 | GISADGSTDYIDSVKG |
| 1146 | 3D08 | GISANGSTDYIDSVKG |
| 1147 | 3D09 | GISANGSTTYIDSVKG |
| 1148 | 3D010 | GISADGSTSYIDSVKG |
| 1149 | 3D011 | GISADGSRDYIDSVKG |
| 1150 | 3E01 | GISADGSTMYIDSVKG |
| 1151 | 3E02 | GISPDGSTDYIDSVKG |
| 1152 | 3E03 | GISGDGSTDYIDSVKG |
| 1153 | 3E04 | GISRDGSTDYIDSVKG |
| 1154 | 3E09 | GISRDGSTDYIDSVKG |
| 1155 | 3E011 | GISRDGSTDYIDSVKG |
| 1156 | 3F03 | GISADGSTDYIDSVKG |
| 1157 | 3F05 | GISTDGSTDYIDSVKG |
| 1158 | 3F06 | GISADGSTSYIDSVKG |
| 1159 | 3F08 | GISADGSTLYIDSVKG |
| 1160 | 3F09 | GISRDGSTDYIDSVKG |
| 1161 | 3F010 | GISADGSTVYIDSVKG |
| 1162 | 3F011 | GISTDGSTDYIDSVKG |
| 1163 | 3G01 | GISADGSTLYIDSVKG |
| 1164 | 3G02 | GISADGRTDYIDSVKG |
| 1165 | 3G04 | GISADGSTIYIDSVKG |
| 1166 | 3G06 | GISADGSTLYIDSVKG |
| 1167 | 3G07 | GISRDGSTDYIDSVKG |
| 1168 | 3G08 | GISKDGSTDYIDSVKG |
| 1169 | 3G09 | GISADGSTDYIGSVKG |
| 1170 | 3G010 | GISVDGSTDYIDSVKG |
| 1171 | 3G011 | GISADGSTGYIDSVKG |
| 1172 | 3H01 | GISGDGSTTYIDSVKG |
| 1173 | 3H03 | GISTDGSTDYIDSVKG |
| 1174 | 3H06 | GISADGSTDYFDSVKG |
| 1175 | 3H07 | GISADGSTSYIDSVKG |
| 1176 | 3H09 | GISADGSTDYIDSVKG |
| 1177 | 3H010 | GISADGSTAYIDSVKG |
| 1178 | 3H011 | GISADGSTVYIDSVKG |
| 1179 | 4A01 | GISQDGSTDYIDSVKG |
| 1180 | 4A02 | GISNDGSTDYIDSVKG |
| 1181 | 4A04 | GISARGSTDYIDSVKG |

-continued

| | | |
|---|---|---|
| 1182 | 4A05 | GISADGSTDYIDSVKG |
| 1183 | 4A06 | GISRDGSTDYIDSVKG |
| 1184 | 4A07 | GISADGSTLYIDSVKG |
| 1185 | 4A08 | GISADGSTNYIDSVKG |
| 1186 | 4A010 | GISADGSTVYIDSVKG |
| 1187 | 4A011 | GISADGSTTYIDSVKG |
| 1188 | 4A09 | GISADGSTDYIGSVKG |
| 1189 | 4B01 | GISRDGSTDYIDSVKG |
| 1190 | 4B02 | GISADGSTTYIDSVKG |
| 1191 | 4B04 | GVSSDGSTDYIDSVKG |
| 1192 | 4B05 | GISADGHTDYIDSVKG |
| 1193 | 4B06 | GISADGSTDYFDSVKG |
| 1194 | 4B07 | GISADGSTVYIDSVKG |
| 1195 | 4B08 | GISADGSTDYIASVKG |
| 1196 | 4B09 | GISADGSTDYISSVKG |
| 1197 | 4B011 | GISADGSTVYIDSVKG |
| 1198 | 4C01 | GISADGSTVYIDSVKG |
| 1199 | 4C02 | GISADGSTTYIDSVKG |
| 1200 | 4C03 | GISVDGSTDYIDSVKG |
| 1201 | 4C05 | GISADGSTAYIDSVKG |
| 1202 | 4C06 | GISADGSTAYIDSVKG |
| 1203 | 4C07 | GISADGSKDYIDSVKG |
| 1204 | 4C08 | GISADGSTDYFDSVKG |
| 1205 | 4C010 | GISADGSTDYIDSVKG |
| 1206 | 4C011 | GISADGSTVYIDSVKG |
| 1207 | 4D01 | GISADGSTVYIDSVKG |
| 1208 | 4D02 | GISARGSTDYIDSVKG |
| 1209 | 4D03 | GISATGSTDYIDSVKG |
| 1210 | 4D04 | GISKDGSTDYIDSVKG |
| 1211 | 4D05 | GISADGSTVYIDSVKG |
| 1212 | 4D06 | GISPDGSTDYIDSVKG |
| 1213 | 4D08 | GISADGSTHYIDSVKG |
| 1214 | 4D09 | GISADGSTDYILSVKG |
| 1215 | 4D010 | GISADGSTDYIHSVKG |
| 1216 | 4D011 | GISVDGSTDYIDSVKG |
| 1217 | 4E01 | GISRDGSTDYIDSVKG |
| 1218 | 4E02 | GISADGSTVYIDSVKG |
| 1219 | 4E06 | GISADGSTDYIRSVKG |
| 1220 | 4E07 | GISADGSTMYIDSVKG |
| 1221 | 4E08 | GISTDGSTDYIDSVKG |

| | | |
|---|---|---|
| 1222 | 4E09 | GISADGSTLYIDSVKG |
| 1223 | 4E010 | GISADGSTDYIDSVKG |
| 1224 | 4E011 | GISATGSTDYIDSVKG |
| 1225 | 4F02 | GISHDGSTDYIDSVKG |
| 1226 | 4F03 | GISYDGSTDYIDSVKG |
| 1227 | 4F04 | GISTDGSTDYIDSVKG |
| 1228 | 4F08 | GISADGSTAYIDSVKG |
| 1229 | 4F09 | GISADGSTDYIESVKG |
| 1230 | 4F010 | GISIDGSTDYIKSVKG |
| 1231 | 4F011 | GISADGSKDYIDSVKG |
| 1232 | 4G01 | GISADGSTVYIDSVKG |
| 1233 | 4G02 | GISRDGSTDYIDSVKG |
| 1234 | 4G03 | GISADGSTDYIHSVKG |
| 1235 | 4G05 | GISADGSTIYIDSVKG |
| 1236 | 4G07 | GISANGSTDYIDSVKG |
| 1237 | 4G08 | GISTDGSTDYIDSVKG |
| 1238 | 4G09 | GISYDGSTDYIDSVKG |
| 1239 | 4G010 | GISADGSTDYIASVKG |
| 1240 | 4G011 | GISADGSTDYIGSVKG |
| 1241 | 4H01 | GISANGSTDYYDSVKG |
| 1242 | 4H03 | GISADGSTSYIDSVKG |
| 1243 | 4H04 | GVSADGSTDYIDSVKG |
| 1244 | 4H05 | GISARGSTDYIDSVKG |
| 1245 | 4H06 | GISADGSTIYIDSVKG |
| 1246 | 4H07 | GISANGSTDYIDSVKG |
| 1247 | 4H08 | GISADGSTDYVDSVKG |
| 1248 | 4H09 | GISADGSTDYRDSVKG |
| 1249 | 4H011 | GISVDGSTDYIDSVKG |
| 1250 | 4D09-M34L | GISADGSTDYILSVKG |
| 1251 | 4H11-M34L | GISVDGSTDYIDSVKG |
| 1252 | 41B11 | GISSDGSKVFNESVKG |
| 1253 | 41C02 | GISSDGSEVYTDSVKG |
| 1254 | 41D01 | GISSDDSNVYYESVKG |
| 1255 | 41D02 | GISSDGSKVYADSVKG |
| 1256 | 41D03 | GISSDESTLYVDSVKG |
| 1257 | 41D07 | GISSDDSKVYSDSVKG |
| 1258 | 41E01 | GISSDGSQVYGASVKG |
| 1259 | 41E02 | GISSDGSKVYADSVKG |

| | | -continued |
|---|---|---|
| 1260 | 41F07 | GISSDGSNMYADSVKG |
| 1261 | 41G01 | GISSDGSKVYTDSVKG |
| 1262 | 42A03 | GISSDGSKVSAESVKG |
| 1263 | 42A06 | GISSDGSKVYDDSVKG |
| 1264 | 42A07 | GISSDGSKVYDDSVKG |
| 1265 | 42A08 | GISSDGSAVYVGSVKG |
| 1266 | 42A11 | GISSDGSYVYSESVKG |
| 1267 | 42B06 | GISSDSSHVYADSVKG |
| 1268 | 42B10 | GISSDSSIVYTDSVKG |
| 1269 | 42C01 | GISSDGSEVNTDSVKG |
| 1270 | 42C03 | GISSDGSKLSSDSVKG |
| 1271 | 42C07 | GISSDNSKVYADSVKG |
| 1272 | 42C08 | GISSDGSRVYFDSVKG |
| 1273 | 42C10 | GISSDGSLVYAESVKG |
| 1274 | 42C11 | GISSDGSVVYVDSVKG |
| 1275 | 42D05 | GISSDGSKVYVDSVKG |
| 1276 | 42D06 | GISSDGSKLYDESVKG |
| 1277 | 42D07 | GISSDYSKLYADSVKG |
| 1278 | 42D08 | GISSDSSKVYTESVKG |
| 1279 | 42E01 | GISSDGSQVYVDSVKG |
| 1280 | 42E02 | GISSDGSKVYSDSVKG |
| 1281 | 42E05 | GISSDGSKVYDDSVKG |
| 1282 | 42E06 | GISSDGSKVYADSVKG |
| 1283 | 42E07 | GISSDGSSVYADSVKG |
| 1284 | 42F01 | GISSDGSQVYYGSVKG |
| 1285 | 42F08 | GISSDGSKVYTDSVKG |
| 1286 | 42F10 | GISSDGSKVSADSVKG |
| 1287 | 42G05 | GISSDGSKVYEDSVKG |
| 1288 | 42G07 | GISSDRSKVYADSVKG |
| 1289 | 42H05 | GISSDGSKVYAESVKG |
| 1290 | 42H08 | GISSDGSVVTTESVKG |
| 1291 | 42H11 | GISSDGSHVHQESVKG |
| 1292 | 51A01 | GISADGSTVYVESVKG |
| 1293 | 51A02 | GISSDGSTVYIDSVKG |
| 1294 | 51A03 | GISVDGSTHYVASVKG |
| 1295 | 51A05 | GISTDGSKHYIDSVKG |
| 1296 | 51B01 | GISYDGSKYYAESVKG |
| 1297 | 51B04 | GISANGSRTYMESVKG |
| 1298 | 51B11 | GISPDGSTDYVDSVKG |
| 1299 | 51C02 | GISPNGSAVYTESVKG |

| | | |
|---|---|---|
| 1300 | 51D01 | GISPDGSTAYMESVKG |
| 1301 | 51D03 | GISNDGSTDYIDSVKG |
| 1302 | 51E02 | GISTDGSAVYFDSVKG |
| 1303 | 51E03 | GISTGGSTHYIESVKG |
| 1304 | 51E05 | GISTDGSTVYIDSVKG |
| 1305 | 51F01 | GISNEGSTYYMDSVKG |
| 1306 | 51F02 | GISADGSHVYTNSVKG |
| 1307 | 51F03 | GISDDGSRYYTDSVKG |
| 1308 | 51F04 | GISAEGSTLYMESVKG |
| 1309 | 51G02 | GISTDGSTVYIDSVKG |
| 1310 | 51G04 | GISANGSTSYIDSVKG |
| 1311 | 51G10 | GISDDGSRHYIESVKG |
| 1312 | 51H04 | GISPDGSTVYIESVKG |
| 1313 | 51H05 | GISDDGSTVYVDSVKG |
| 1314 | 52B01 | GISDDGSTVYFDSVKG |
| 1315 | 52C04 | GISDEGSTVYIGSVKG |
| 1316 | 52D04 | GISDDGSIVYMDSVKG |
| 1317 | 53A04 | GISDDGSKHYFDSVKG |
| 1318 | 53A05 | GISTDGSTDYLHSVKG |
| 1319 | 53A09 | GISDDGSKHYFDSVKG |
| 1320 | 53B05 | GISYDGSTVYVESVKG |
| 1321 | 53B06 | GISDDGSTVYIDSVKG |
| 1322 | 53C03 | GISDDGSTVYVDSVKG |
| 1323 | 53C04 | GISDDGSQVYIDSVKG |
| 1324 | 53H03 | GISVDGSTVYSDSVKG |
| 1325 | 53H04 | GISDDGSNVYIDSVKG |
| 1326 | 54B05 | GISTDGSTVYFVSVKG |

| SEQ. ID NO. | name | CDR3 |
|---|---|---|
| 1327 | DL1 | RYFERTD |
| 1328 | DL74 | RYFERTD |
| 1329 | DL31 | RYFERTD |
| 1330 | DL3 | YQGLYAY |
| 1331 | DL80 | RVFDHVY |
| 1332 | DL18 | RAFGRDY |
| 1333 | DL94 | RTMGRDY |
| 1334 | DL17 | WDGVGGAY |
| 1335 | DL46 | WDGVGGAY |
| 1336 | DL15 | WNGVGGAY |
| 1337 | DL26 | WDGVGGAY |

-continued

| | | |
|---|---|---|
| 1338 | DL83 | WDGVGGAY |
| 1339 | DL5 | RSWNNY |
| 1340 | DL22 | RSWNNY |
| 1341 | DL85 | RSWNNY |
| 1342 | DL69 | ESFGRIWYN |
| 1343 | DL27 | QHFGTDS |
| 1344 | DL51 | QQFGTDS |
| 1345 | DL54 | YGIQRAEGY |
| 1346 | DL11 | YRWVGRDTY |
| 1347 | DL19 | YRWVGRDTY |
| 1348 | DL68 | YRWVGRDTY |
| 1349 | DL14 | YRWEGRDTY |
| 1350 | DL67 | YRWEGRNTY |
| 1351 | DL56 | YRWVGRYTY |
| 1352 | DL13 | YRWVGRDTY |
| 1353 | DL77 | YRWVGRDTY |
| 1354 | DL79 | YRWVGRDTY |
| 1355 | DL20 | YRWVDRYTY |
| 1356 | DL41 | YRWIDRYTY |
| 1357 | DL59 | YRWVDRYTY |
| 1358 | DL16 | YRWVGRDTY |
| 1359 | DL6 | YRWTTRYTY |
| 1360 | DL84 | YRWVGGYTY |
| 1361 | DL2 | FRTVAASSMQY |
| 1362 | DL43 | FRTVSGSSMRY |
| 1363 | DL92 | NRGFAGAPSY |
| 1364 | DL10 | YFQSSY |
| 1365 | DL82 | YFQSSY |
| 1366 | DL23 | YFQSSY |
| 1367 | DL42 | HWTQGSVPKES |
| 1368 | DL45 | RSYSSDY |
| 1369 | DL58 | RYGDINY |
| 1370 | DL70 | RYGDINY |
| 1371 | DL89 | YDSRSY |
| 1372 | DL38 | YDNINAY |
| 1373 | DL52 | YDNINAY |
| 1374 | DL64 | YDNINAY |
| 1375 | DL33 | YDNINAY |
| 1376 | DL12 | WIAGKAY |

| | | -continued |
|---|---|---|
| 1377 | DL29 | RSQLGST |
| 1378 | DL61 | YYLDTYAY |
| 1379 | DH1 | RYFERTD |
| 1380 | DH10 | YFQSSY |
| 1381 | DH11 | YRWVGRDTY |
| 1382 | DH12 | WIAGKAY |
| 1383 | DH15 | WNGVGGAY |
| 1384 | DH17 | WDGVGGAY |
| 1385 | DH18 | RAFGRDY |
| 1386 | DH2 | FRTVAASSMQY |
| 1387 | DH22 | RSWNNY |
| 1388 | DH23 | YFQSSY |
| 1389 | DH27 | QHFGTDS |
| 1390 | DH29 | RSQLGST |
| 1391 | DH3 | YQGLYAY |
| 1392 | DH38 | YDNINAY |
| 1393 | DH42 | HWTQGSVPKES |
| 1394 | DH43 | FRTVSGSSMRY |
| 1395 | DH45 | RSYSSDY |
| 1396 | DH5 | RSWNNY |
| 1397 | DH51 | QQFGTDS |
| 1398 | DH54 | YGIQRAEGY |
| 1399 | DH56 | YRWVGRYTY |
| 1400 | DH58 | RYGDINY |
| 1401 | DH6 | YRWTTRYTY |
| 1402 | DH61 | YYLDTYAY |
| 1403 | DH67 | YRWEGRNTY |
| 1404 | DH69 | ESFGRIWYN |
| 1405 | DH70 | RYGDINY |
| 1406 | DH80 | RVFDHVY |
| 1407 | DH82 | YFQSSY |
| 1408 | DH83 | WDGVGGAY |
| 1409 | DH84 | YRWVGGYTY |
| 1410 | DH89 | YDSRSY |
| 1411 | DH92 | NRGFAGAPSY |
| 1412 | DH94 | RTMGRDY |
| 1413 | 1A01 | FRHVSGSSMRY |
| 1414 | 1A03 | FRTVSGSSSRY |
| 1415 | 1A04 | FRTVSGSSMRY |
| 1416 | 1A05 | FRTVRGSSMSY |

-continued

| | | |
|---|---|---|
| 1417 | 1A06 | FRTVSGSSKRY |
| 1418 | 1A07 | FRMVSGSSMRY |
| 1419 | 1A09 | FRTVQGSSMRY |
| 1420 | 1A010 | FRTVYGSSMRY |
| 1421 | 1A011 | FRTVSGSSYRY |
| 1422 | 1A012 | FRTVLGSSMRY |
| 1423 | 1B01 | FRRVSGSSMRY |
| 1424 | 1B02 | FRTVSGSSMRY |
| 1425 | 1B03 | FRTVSGSSARY |
| 1426 | 1B04 | FRIVRGSSMRY |
| 1427 | 1B05 | YRTVSGSSMRY |
| 1428 | 1B07 | FRHVSGSSMRY |
| 1429 | 1B08 | FRFVSGSSMRY |
| 1430 | 1B09 | FRTVSGSSMRY |
| 1431 | 1B010 | FRTKSGSSMRY |
| 1432 | 1B011 | FRTVYGSSMRY |
| 1433 | 1C01 | FRTVSGSSMGY |
| 1434 | 1C02 | FRTVSGSSMRS |
| 1435 | 1C03 | FRTVGGSSMRY |
| 1436 | 1C04 | FRTVSGSSMRY |
| 1437 | 1C05 | FRTVSGSHMRY |
| 1438 | 1C06 | FRAVSGSSMRY |
| 1439 | 1C07 | FRTVSGSSMRY |
| 1440 | 1C08 | FRTVSGSPMRY |
| 1441 | 1C010 | FRTVSGSSMSY |
| 1442 | 1C011 | FRTVSGSSMRY |
| 1443 | 1C012 | FRTVRGSSMRY |
| 1444 | 1D01 | FRTVRGSSMRY |
| 1445 | 1D02 | FRQVSGSSMRY |
| 1446 | 1D03 | FRIVSGSSMGY |
| 1447 | 1D04 | FRTVSGASMRY |
| 1448 | 1D06 | FRTVHGSSMRY |
| 1449 | 1D08 | FRMVSGSSMRY |
| 1450 | 1D09 | FRTISGSSMRY |
| 1451 | 1D010 | FRTRSGSSMRY |
| 1452 | 1D011 | FRTVSGHSMRY |
| 1453 | 1D012 | FRTVSGGSMRY |
| 1454 | 1E02 | FRTKSGSSMRY |
| 1455 | 1E04 | FRTASGTSMRY |

-continued

| | | |
|---|---|---|
| 1456 | 1E05 | FNTVSGSSMRY |
| 1457 | 1E07 | FRTVRGSSQRY |
| 1458 | 1E08 | FRTVLGSSMRY |
| 1459 | 1E09 | FRTRSGSSMRY |
| 1460 | 1E010 | FRTVSGLSMRY |
| 1461 | 1E011 | FRTVRGSSQRY |
| 1462 | 1E012 | FRTVSGSSMVY |
| 1463 | 1F01 | FRTVSRSSMRY |
| 1464 | 1F02 | FRTVSGSSMSY |
| 1465 | 1F04 | FRTVSGSSARY |
| 1466 | 1F05 | FHTVSGSSMRY |
| 1467 | 1F06 | FRTVLGSSMRY |
| 1468 | 1F07 | FRTVSGSSMRY |
| 1469 | 1F08 | FRNVSGSSMRY |
| 1470 | 1F09 | FRTVTGSSMRY |
| 1471 | 1F010 | FRTVSGSSMRY |
| 1472 | 1F011 | FRTVKGSSMRY |
| 1473 | 1F012 | FRTNSGSSMRY |
| 1474 | 1G01 | FRTVSGASMRY |
| 1475 | 1G04 | FRTVNLSSMRY |
| 1476 | 1G05 | FRTVTGSSMRY |
| 1477 | 1G06 | FRKVSGSSARY |
| 1478 | 1G07 | FRTYSGSSMRY |
| 1479 | 1G09 | FRTVSKSSMRY |
| 1480 | 1G011 | FKTVSGSSMRY |
| 1481 | 1H01 | FRTRSGSSMRY |
| 1482 | 1H02 | FRTSSGSSMRY |
| 1483 | 1H06 | FRFLSGSSMRY |
| 1484 | 1H07 | FRTVSGSSMRY |
| 1485 | 1H08 | FRLVSGSSMRY |
| 1486 | 1H010 | FRTVSGSSMRF |
| 1487 | 1H011 | FRTQSGSSMRY |
| 1488 | 1H012 | FRTVSGSSMPY |
| 1489 | 2A01 | FRTLSGSSMRY |
| 1490 | 2A03 | FRTVSGSAMRY |
| 1491 | 2A04 | FRTTSGSSMRY |
| 1492 | 2A05 | FRTVSGTSMRY |
| 1493 | 2A06 | FRTRSGSSMRY |
| 1494 | 2A08 | FRTSSGSSMRY |
| 1495 | 2A09 | FRTVSGSSMSY |

-continued

| | | |
|---|---|---|
| 1496 | 2A011 | FRPVSGSSMRY |
| 1497 | 2B01 | FRHVSGSSMRY |
| 1498 | 2B02 | FRTKSGSSMRY |
| 1499 | 2B03 | FTTVSGSSMRY |
| 1500 | 2B05 | FHTVSGSSMRY |
| 1501 | 2B07 | FRTVRGSSMRY |
| 1502 | 2B010 | FRTVLGSSMRY |
| 1503 | 2B011 | FRTVSGSSMRS |
| 1504 | 2B012 | FRTVRGSSMRY |
| 1505 | 2C01 | FRYVSGSSMRY |
| 1506 | 2C02 | FRTVYGSSMRY |
| 1507 | 2C04 | FRTVLGSSMRY |
| 1508 | 2C06 | YRTVSGSSMRY |
| 1509 | 2C07 | FRSVSGSSMRY |
| 1510 | 2C08 | FRRVSGSSMRY |
| 1511 | 2C09 | FRTVSGTSMRY |
| 1512 | 2C010 | FRTVAGSSMRY |
| 1513 | 2D02 | FRIVSGSSMRY |
| 1514 | 2D03 | FRTVSGVSMRY |
| 1515 | 2D04 | FRTVQGSSMRY |
| 1516 | 2D05 | FRTASGSSMRY |
| 1517 | 2D06 | FRTVSGSSSRY |
| 1518 | 2D07 | FRTVQGSSMRY |
| 1519 | 2D09 | FRTVRGSSMRY |
| 1520 | 2D010 | FRTKSGSSMRY |
| 1521 | 2D011 | FRTVWGSSMRY |
| 1522 | 2D012 | FRTRSGSSMRY |
| 1523 | 2E01 | FHTVCGTSMGY |
| 1524 | 2E02 | FRTVSGSSQRY |
| 1525 | 2E05 | FRTVSGSSMSY |
| 1526 | 2E06 | FRTVRGSSMRY |
| 1527 | 2E08 | FRTQSGSSMRY |
| 1528 | 2E09 | FRTLSGSSMRY |
| 1529 | 2E010 | FHTVSGSSMRY |
| 1530 | 2E011 | FRRVSGSSMRY |
| 1531 | 2F01 | FRLVSGSSMRY |
| 1532 | 2F02 | FRTVSGSYMRY |
| 1533 | 2F03 | FRTVGGSSMRY |
| 1534 | 2F06 | FRTHSGSSMRY |

-continued

| | | |
|---|---|---|
| 1535 | 2F07 | FRTVSTSSMRY |
| 1536 | 2F08 | FRTVLGTSMRY |
| 1537 | 2F09 | FRTVSGSSMRY |
| 1538 | 2F11 | FRTVSGSSMGY |
| 1539 | 2G03 | FRTVSGSSMRA |
| 1540 | 2G04 | FRILSGSSMRY |
| 1541 | 2G07 | FRTVQGSSMRY |
| 1542 | 2G08 | FRTVSGQSMGY |
| 1543 | 2G09 | FRTVSGSSARY |
| 1544 | 2G011 | FRYVSGSSMRY |
| 1545 | 2H010 | FRTVSGSSMRY |
| 1546 | 2H011 | FRRVSGSSMRY |
| 1547 | 2H02 | FHTVSGSSMRY |
| 1548 | 2H03 | FRQVSGSSMRY |
| 1549 | 2H04 | FRTVSGSYMRY |
| 1550 | 2H06 | FRTASGSSMRY |
| 1551 | 2H07 | FRTVSGHSMRY |
| 1552 | 2H08 | FRTVSGSSSRY |
| 1553 | 2E05-M106Y | FRTVSGSSYSY |
| 1554 | 2E05-M106Q | FRTVSGSSQSY |
| 1555 | 3A01 | YRWTRRYTY |
| 1556 | 3A02 | YRWRTRYTY |
| 1557 | 3A03 | YRWTTRRTY |
| 1558 | 3A04 | YRWTTRYIY |
| 1559 | 3A05 | YRWRTRYTY |
| 1560 | 3A06 | YRWTRRYTY |
| 1561 | 3A08 | YRWRTRYTY |
| 1562 | 3A09 | YRWTTRYIY |
| 1563 | 3A010 | YRWTTRRTY |
| 1564 | 3A011 | YRWRTRYTY |
| 1565 | 3B01 | YRWTTRYTY |
| 1566 | 3B02 | YRWRTRYTY |
| 1567 | 3B04 | YHWTTRYTY |
| 1568 | 3B05 | YRWTTRRTY |
| 1569 | 3B06 | YRWTTRYTY |
| 1570 | 3B07 | YRWTTRYTY |
| 1571 | 3B09 | YRWTTRYAY |
| 1572 | 3B010 | YRWVTRYTY |
| 1573 | 3B011 | YRWVTRYTY |

-continued

| | | |
|---|---|---|
| 1574 | 3C01 | YRWSTRYTY |
| 1575 | 3C02 | YRWRTRYTY |
| 1576 | 3C03 | YRWTTRGTY |
| 1577 | 3C04 | YRWDTRYTY |
| 1578 | 3C05 | YRWTTRRTY |
| 1579 | 3C06 | YRWRTRYTY |
| 1580 | 3C08 | YRWTGRYTY |
| 1581 | 3C09 | YRWRTRYTY |
| 1582 | 3C011 | YRWRTRYTY |
| 1583 | 3D01 | YRWITRYTY |
| 1584 | 3D02 | YRWITRYTY |
| 1585 | 3D03 | YRWRTRYTY |
| 1586 | 3D05 | YRWTRRYTY |
| 1587 | 3D07 | YSWTTRYTY |
| 1588 | 3D08 | YRWTNRYTY |
| 1589 | 3D09 | YRWTTRYRY |
| 1590 | 3D010 | YRWTTRYTY |
| 1591 | 3D011 | YRWTTRYKY |
| 1592 | 3E01 | YRWHTRYTY |
| 1593 | 3E02 | YRWTRRYTY |
| 1594 | 3E03 | YRWMTRYTY |
| 1595 | 3E04 | YRWTTRYRY |
| 1596 | 3E09 | YRWSTRYTY |
| 1597 | 3E011 | YRWTTRYTF |
| 1598 | 3F03 | YRWRTRYTY |
| 1599 | 3F05 | YRWTTRRTY |
| 1600 | 3F06 | YRWATRYTY |
| 1601 | 3F08 | YRWHTRYTY |
| 1602 | 3F09 | YRWGTRYTY |
| 1603 | 3F010 | YRWTTRNTY |
| 1604 | 3F011 | YRWRTRYTY |
| 1605 | 3G01 | YRWTTRYAY |
| 1606 | 3G02 | YRWRTRYTY |
| 1607 | 3G04 | YRWTTRRTY |
| 1608 | 3G06 | YRWTTRRTY |
| 1609 | 3G07 | YRWTSRYTY |
| 1610 | 3G08 | YRWTTRVTY |
| 1611 | 3G09 | YRWTTRTTY |
| 1612 | 3G010 | YRWRTRYTY |

-continued

| | | |
|---|---|---|
| 1613 | 3G011 | YRWATRYTY |
| 1614 | 3H01 | YRWTTRRTY |
| 1615 | 3H03 | LRWTTRYTY |
| 1616 | 3H06 | YRWTTRGTY |
| 1617 | 3H07 | YRWRTRYTY |
| 1618 | 3H09 | YRWTTRATY |
| 1619 | 3H010 | YRWTTRRTY |
| 1620 | 3H011 | YRWPTRYTY |
| 1621 | 4A01 | YRWRTRYTY |
| 1622 | 4A02 | YRWKTRYTY |
| 1623 | 4A04 | YRWSTRYTY |
| 1624 | 4A05 | YRWKTRRTY |
| 1625 | 4A06 | YRWTTRRTY |
| 1626 | 4A07 | YRWTTRYRY |
| 1627 | 4A08 | YRWRTRYTY |
| 1628 | 4A010 | YRWTTRYKY |
| 1629 | 4A011 | YRWKTRYTY |
| 1630 | 4A09 | YRWTTRVTY |
| 1631 | 4B01 | YRWTTRFTY |
| 1632 | 4B02 | YRWTTRFTY |
| 1633 | 4B04 | YRWRTRYTY |
| 1634 | 4B05 | YRWTTRYTH |
| 1635 | 4B06 | YRWTRRYTY |
| 1636 | 4B07 | YRWTTRYTY |
| 1637 | 4B08 | YRWTTRSTY |
| 1638 | 4B09 | YSWTTRYTY |
| 1639 | 4B011 | YRWTTRGTY |
| 1640 | 4C01 | YRWKTRYTY |
| 1641 | 4C02 | YRWTTRFTY |
| 1642 | 4C03 | YRWRTRYTY |
| 1643 | 4C05 | YRWTTRRTY |
| 1644 | 4C06 | YRWSTRYTY |
| 1645 | 4C07 | YRWTTRLTY |
| 1646 | 4C08 | YRWTRRYTY |
| 1647 | 4C010 | YRWTTRLTY |
| 1648 | 4C011 | YRWTRRYTY |
| 1649 | 4D01 | YRWTTRRTY |
| 1650 | 4D02 | YQWTTRYTY |
| 1651 | 4D03 | YRWTRRYTY |
| 1652 | 4D04 | YRWTTRMTY |

| | | |
|---|---|---|
| 1653 | 4D05 | YRWTTRRTY |
| 1654 | 4D06 | YRWTTRYRY |
| 1655 | 4D08 | YRWLTRYTY |
| 1656 | 4D09 | YEWTTRYTY |
| 1657 | 4D010 | YRWRTRYTY |
| 1658 | 4D011 | YRWRTRYTY |
| 1659 | 4E01 | YRWRTRYTY |
| 1660 | 4E02 | YRWSTRYTY |
| 1661 | 4E06 | YRWTTRLTY |
| 1662 | 4E07 | YRWTTRLTY |
| 1663 | 4E08 | YKWTTRYTY |
| 1664 | 4E09 | YRWTTRSTY |
| 1665 | 4E010 | YRWRTRYTY |
| 1666 | 4E011 | YRWSTRYTY |
| 1667 | 4F02 | YRWTTRYTY |
| 1668 | 4F03 | YRWRTRYTY |
| 1669 | 4F04 | YRWLTRYTY |
| 1670 | 4F08 | YRWRTRYTY |
| 1671 | 4F09 | YRWTTRYTY |
| 1672 | 4F010 | YRWTTRYRY |
| 1673 | 4F011 | YRWTTRYTY |
| 1674 | 4G01 | YRWPTRYTY |
| 1675 | 4G02 | YRWTTRHTY |
| 1676 | 4G03 | YRWTRRYTY |
| 1677 | 4G05 | YRWHTRYTY |
| 1678 | 4G07 | YRWTNRYTY |
| 1679 | 4G08 | YRWTTRYRY |
| 1680 | 4G09 | YRWTTRRTY |
| 1681 | 4G010 | YRWSTRYTY |
| 1682 | 4G011 | YRWSTRYTY |
| 1683 | 4H01 | YRWRTRYTY |
| 1684 | 4H03 | YRWTTRYTY |
| 1685 | 4H04 | YEWTTRYTY |
| 1686 | 4H05 | YRWTTRSTY |
| 1687 | 4H06 | YRWTTRYTY |
| 1688 | 4H07 | YRWSTRYTY |
| 1689 | 4H08 | YRWSTRYTY |
| 1690 | 4H09 | YRWTYRYTY |
| 1691 | 4H011 | YRWTTRLTY |

-continued

| | | |
|---|---|---|
| 1692 | 4D09-M34L | YEWTTRYTY |
| 1693 | 4H11-M34L | YRWTTRLTY |
| 1694 | 41B11 | FRPAAGSPMRY |
| 1695 | 41C02 | FRTVDGSPLRY |
| 1696 | 41D01 | FRTVSGSSKRY |
| 1697 | 41D02 | FSAGSGTEMSY |
| 1698 | 41D03 | FGSLSGSSTTY |
| 1699 | 41D07 | FGSVSGSWTRY |
| 1700 | 41E01 | FRLVSGSSMSY |
| 1701 | 41E02 | FRTGSGTSKSY |
| 1702 | 41F07 | FSNMSGTTRRY |
| 1703 | 41G01 | FRTVPGSAMGY |
| 1704 | 42A03 | FRAESGSSMGY |
| 1705 | 42A06 | FRTLYGSSRSY |
| 1706 | 42A07 | FSPFSGSDTGY |
| 1707 | 42A08 | FSTFSGSSISY |
| 1708 | 42A11 | FRTLAGSEMRY |
| 1709 | 42B06 | FRTVSGSGVRY |
| 1710 | 42B10 | FRPGAGHSNSY |
| 1711 | 42C01 | FRRASGTAMSY |
| 1712 | 42C03 | FTSASGTDLSY |
| 1713 | 42C07 | FRSANGSSKRY |
| 1714 | 42C08 | FKTIAGAGMRY |
| 1715 | 42C10 | FRYGSGSSLSY |
| 1716 | 42C11 | FRTVPGASMKY |
| 1717 | 42D05 | FRTVDGSAISY |
| 1718 | 42D06 | FRTVKGSGGSY |
| 1719 | 42D07 | FRTVSGSSRGY |
| 1720 | 42D08 | FRPGPGSQMAY |
| 1721 | 42E01 | FRTVAGSASGY |
| 1722 | 42E02 | FRTVSGSSYSY |
| 1723 | 42E05 | FINLKGSSMAY |
| 1724 | 42E06 | FRMVTGSYGGY |
| 1725 | 42E07 | FKSSYGLPMRY |
| 1726 | 42F01 | FKTVSGQSLRY |
| 1727 | 42F08 | FRTVTGRAARY |
| 1728 | 42F10 | FGPAIGASRTY |
| 1729 | 42G05 | FRTVSGAPKSY |
| 1730 | 42G07 | FHTVSGSSMSY |

-continued

| | | |
|---|---|---|
| 1731 | 42H05 | FRRLEGYSNRY |
| 1732 | 42H08 | FRTGSGSSMGY |
| 1733 | 42H11 | FTTVTGSSMSY |
| 1734 | 51A01 | YYWTERRPY |
| 1735 | 51A02 | YSWDDAHPY |
| 1736 | 51A03 | YRWMTRLTY |
| 1737 | 51A05 | YDWADAQPY |
| 1738 | 51B01 | YSWTDRLPY |
| 1739 | 51B04 | YRWATRLPY |
| 1740 | 51B11 | YKWSNRLPY |
| 1741 | 51C02 | YGWKTRQPY |
| 1742 | 51D01 | YRWPNRRGY |
| 1743 | 51D03 | YDWTTRQRY |
| 1744 | 51E02 | YNWSYAQPY |
| 1745 | 51E03 | YNWTDSLQY |
| 1746 | 51E05 | YSWTTSLPY |
| 1747 | 51F01 | YKWRSRSTY |
| 1748 | 51F02 | YSQTTRDPY |
| 1749 | 51F03 | YRWTARDTY |
| 1750 | 51F04 | YRWTSRLSY |
| 1751 | 51G02 | YSWTTRSRY |
| 1752 | 51G04 | YNWTSRYRY |
| 1753 | 51G10 | YSWKTRFPY |
| 1754 | 51H04 | YSWTTRYPY |
| 1755 | 51H05 | YEWTNALPY |
| 1756 | 52B01 | YSWITRSPY |
| 1757 | 52C04 | YSWTTRRQY |
| 1758 | 52D04 | YSWITRSPY |
| 1759 | 53A04 | YRWEESRQY |
| 1760 | 53A05 | YTWTTRLPY |
| 1761 | 53A09 | YRWEESRQY |
| 1762 | 53B05 | YSWTTRQPY |
| 1763 | 53B06 | YVWGTRLPY |
| 1764 | 53C03 | YEWTNALPY |
| 1765 | 53C04 | YRWEDALTY |
| 1766 | 53H03 | YSWTTRYPY |
| 1767 | 53H04 | YSWIDSLRY |
| 1768 | 54B05 | YSWTTPRAY |

-continued

| SEQ ID NO: | Description | AA Sequence |
|---|---|---|
| 1769 | Anti-HSA sdAb clone 6C | EVQLVESGGGLVQPGNSLRLSCAASGFTFSRFGMSWVRQAPGKGLEWVSS ISGSGSDTLYADSVKGRFTISRDNAKTTLYLQMNSLRPEDTAVYYCTIGG SLSRSSQGTLVTVSS |
| 1770 | Anti-HSA sdAb clone 7A | EVQLVESGGGLVQPGNSLRLSCAASGFTFSKFGMSWVRQAPGKGLEWVSS ISGSGADTLYADSLKGRFTISRDNAKTTLYLQMNSLRPEDTAVYYCTIGG SLSKSSQGTLVTVSS |
| 1771 | Anti-HSA sdAb clone 7G | EVQLVESGGGLVQPGNSLRLSCAASGFTYSSFGMSWVRQAPGKGLEWVSS ISGSGSDTLYADSVKGRFTISRDNAKTTLYLQMNSLRPEDTAVYYCTIGG SLSKSSQGTLVTVSS |
| 1772 | Anti-HSA sdAb clone 8H | EVQLVESGGGLVQPGNSLRLSCAASGFTFSKFGMSWVRQAPGKGLEWVSS ISGSGTDTLYADSVKGRFTISRDNAKTTLYLQMNSLRPEDTAVYYCTIGG SLSRSSQGTLVTVSS |
| 1773 | Anti-HSA sdAb clone 9A | EVQLVESGGGLVQPGNSLRLSCAASGFTFSRFGMSWVRQAPGKGLEWVSS ISGSGSDTLYADSVKGRFTISRDNAKTTLYLQMNSLRPEDTAVYYCTIGG SLSKSSQGTLVTVSS |
| 1774 | Anti-HSA sdAb clone 10G | EVQLVESGGGLVQPGNSLRLSCAASGFTFSKFGMSWVRQAPGKGLEWVSS ISGSGRDTLYADSVKGRFTISRDNAKTTLYLQMNSLRPEDTAVYYCTIGG SLSVSSQGTLVTVSS |
| 1775 | wt anti-HSA | EVQLVESGGGLVQPGNSLRLSCAASGFTFSSFGMSWVRQAPGKGLEWVSS ISGSGSDTLYADSVKGRFTISRDNAKTTLYLQMNSLRPEDTAVYYCTIGG SLSRSSQGTLVTVSS |
| 1776 | Anti-HSA sdAb clone 6CE | EVQLVESGGGLVQPGNSLRLSCAASGFTFSRFGMSWVRQAPGKGLEWVSS ISGSGSDTLYAESVKGRFTISRDNAKTTLYLQMNSLRPEDTAVYYCTIGG SLSRSSQGTLVTVSS |
| 1777 | Anti-HSA sdAb clone 8HE | EVQLVESGGGLVQPGNSLRLSCAASGFTFSKFGMSWVRQAPGKGLEWVSS ISGSGTDTLYAESVKGRFTISRDNAKTTLYLQMNSLRPEDTAVYYCTIGG SLSRSSQGTLVTVSS |
| 1778 | Anti-HSA sdAb clone 10GE | EVQLVESGGGLVQPGNSLRLSCAASGFTFSKFGMSWVRQAPGKGLEWVSS ISGSGRDTLYAESVKGRFTISRDNAKTTLYLQMNSLRPEDTAVYYCTIGG SLSVSSQGTLVTVSS |
| 1779 | wt anti-HSA CDR1 | GFTFSSFGMS |
| 1780 | wt anti-HSA CDR2 | SISGSGSDTLYADSVK |
| 1781 | wt anti-HSACDR3 | GGSLSR |
| 1782 | CDR1 variant 1 | GFTFSRFGMS |
| 1783 | CDR1 variant 2 | GFTFSKFGMS |
| 1784 | CDR1 variant 3 | GFTYSSFGMS |
| 1785 | CDR2 variant 1 | SISGSGADTLYADSLK |
| 1786 | CDR2 variant 2 | SISGSGTDTLYADSVK |
| 1787 | CDR2 variant 3 | SISGSGRDTLYADSVK |
| 1788 | CDR2 variant 4 | SISGSGSDTLYAESVK |
| 1789 | CDR2 variant 5 | SISGSGTDTLYAESVK |
| 1790 | CDR2 variant 6 | SISGSGRDTLYAESVK |
| 1791 | CDR3 variant 1 | GGSLSK |
| 1792 | CDR3 variant 2 | GGSLSV |
| 1793 | Anti-CD3, clone 2B2 | EVQLVESGGGLVQPGGSLKLSCAASGFTFNKYAINWVRQAPGKGLEWVAR IRSKYNNYATYYADQVKDRFTISRDDSKNTAYLQMNNLKTEDTAVYYCVR HANFGNSYISYWAYWGQGTLVTVSSGGGGSGGGGSGGGGSQTVVTQEPSL TVSPGGTVTLTCASSTGAVTSGNYPNWVQQKPGQAPRGLIGGTKFLVPGT PARFSGSLLGGKAALTLSGVQPEDEAEYYCTLWYSNRWVFGGGTKLTVL |

| | | |
|---|---|---|
| 1794 | Anti-CD3, clone 9F2 | EVQLVESGGGLVQPGGSLKLSCAASGFEFNKYAMNWVRQAPGKGLEWVAR<br>IRSKYNKYATYYADSVKDRFTISRDDSKNTAYLQMNNLKTEDTAVYYCVR<br>HGNFGNSYISYWAYWGQGTLVTVSSGGGGSGGGGSGGGGSQTVVTQEPSL<br>TVSPGGTVTLTCGSSFGAVTSGNYPNWVQQKPGQAPRGLIGGTKFLAPGT<br>PARFSGSLLGGKAALTLSGVQPEDEAEYYCVLWYDNRWVFGGGTKLTVL |
| 1795 | Anti-CD3, clone 5A2 | EVQLVESGGGLVQPGGSLKLSCAASGFTFNKYAMNWVRQAPGKGLEWVAR<br>IRSKYNNYATYYADSVKDRFTISRDDSKNTAYLQMNNLKTEDTAVYYCVR<br>HGNFGNSHISYWAYWGQGTLVTVSSGGGGSGGGGSGGGGSQTVVTQEPSL<br>TVSPGGTVTLTCGSSTGYVTSGNYPNWVQQKPGQAPRGLIGGTSFLAPGT<br>PARFSGSLLGGKAALTLSGVQPEDEAEYYCVLWYSNRWIFGGGTKLTVL |
| 1796 | Anti-CD3, clone 6A2 | EVQLVESGGGLVQPGGSLKLSCAASGFMFNKYAMNWVRQAPGKGLEWVAR<br>IRSKSNNYATYYADSVKDRFTISRDDSKNTAYLQMNNLKTEDTAVYYCVR<br>HGNFGNSYISYWATWGQGTLVTVSSGGGGSGGGGSGGGGSQTVVTQEPSL<br>TVSPGGTVTLTCGSSFGAVTSGNYPNWVQQKPGQAPRGLIGGTKLLAPGT<br>PARFSGSLLGGKAALTLSGVQPEDEAEYYCVLWYSNSWVFGGGTKLTVL |
| 1797 | Anti-CD3, clone 2D2 | EVQLVESGGGLVQPGGSLKLSCAASGFTFNTYAMNWVRQAPGKGLEWVAR<br>IRSKYNNYATYYKDSVKDRFTISRDDSKNTAYLQMNNLKTEDTAVYYCVR<br>HGNFGNSPISYWAYWGQGTLVTVSSGGGGSGGGGSGGGGSQTVVTQEPSL<br>TVSPGGTVTLTCGSSTGAVSGNYPNWVQQKPGQAPRGLIGGTEFLAPGT<br>PARFSGSLLGGKAALTLSGVQPEDEAEYYCVLWYSNRWVFGGGTKLTVL |
| 1798 | Anti-CD3, clone 3F2 | EVQLVESGGGLVQPGGSLKLSCAASGFTYNKYAMNWVRQAPGKGLEWVAR<br>IRSKYNNYATYYADEVKDRFTISRDDSKNTAYLQMNNLKTEDTAVYYCVR<br>HGNFGNSPISYWAYWGQGTLVTVSSGGGGSGGGGSGGGGSQTVVTQEPSL<br>TVSPGGTVTLTCGSSKGAVTSGNYPNWVQQKPGQAPRGLIGGTKELAPGT<br>PARFSGSLLGGKAALTLSGVQPEDEAEYYCTLWYSNRWVFGGGTKLTVL |
| 1799 | Anti-CD3, clone 1A2 | EVQLVESGGGLVQPGGSLKLSCAASGNTFNKYAMNWVRQAPGKGLEWVAR<br>IRSKYNNYETYYADSVKDRFTISRDDSKNTAYLQMNNLKTEDTAVYYCVR<br>HTNFGNSYISYWAYWGQGTLVTVSSGGGGSGGGGSGGGGSQTVVTQEPSL<br>TVSPGGTVTLTCGSSTGAVTSGYYPNWVQQKPGQAPRGLIGGTYFLAPGT<br>PARFSGSLLGGKAALTLSGVQPEDEAEYYCVLWYSNRWVFGGGTKLTVL |
| 1800 | Anti-CD3, clone 1C2 | EVQLVESGGGLVQPGGSLKLSCAASGFTFNNYAMNWVRQAPGKGLEWVAR<br>IRSKYNNYATYYADAVKDRFTISRDDSKNTAYLQMNNLKTEDTAVYYCVR<br>HGNFGNSQISYWAYWGQGTLVTVSSGGGGSGGGGSGGGGSQTVVTQEPSL<br>TVSPGGTVTLTCGSSTGAVTDGNYPNWVQQKPGQAPRGLIGGIKFLAPGT<br>PARFSGSLLGGKAALTLSGVQPEDEAEYYCVLWYSNRWVFGGGTKLTVL |
| 1801 | Anti-CD3, clone 2E4 | EVQLVESGGGLVQPGGSLKLSCAASGFTENKYAYNWVRQAPGKGLEWVAR<br>IRSKYNNYATYYADSVKDRFTISRDDSKNTAYLQMNNLKTEDTAVYYCVR<br>HGNFGNSYISYWAYWGQGTLVTVSSGGGGSGGGGSGGGGSQTVVTQEPSL<br>TVSPGGTVTLTCGESTGAVTSGNYPNWVQQKPGQAPRGLIGGTKILAPGT<br>PARFSGSLLGGKAALTLSGVQPEDEAEYYCVLWYSNRWVFGGGTKLTVL |
| 1802 | Anti-CD3, clone 10E4 | EVQLVESGGGLVQPGGSLKLSCAASGFTFNKYPMNWVRQAPGKGLEWVAR<br>IRSKYNNYATYYADSVKDRFTISRDDSKNTAYLQMNNLKNEDTAVYYCVR<br>HGNFNNSYISYWAYWGQGTLVTVSSGGGGSGGGGSGGGGSQTVVTQEPSL<br>TVSPGGTVTLTCGSSTGAVTKGNYPNWVQQKPGQAPRGLIGGTKMLAPGT<br>PARFSGSLLGGKAALTLSGVQPEDEAEYYCALWYSNRWVFGGGTKLTVL |
| 1897 | Anti-CD3, clone 2H2 | EVQLVESGGGLVQPGGSLKLSCAASGFTFNGYAMNWVRQAPGKGLEWVAR<br>IRSKYNNYATYYADEVKDRFTISRDDSKNTAYLQMNNLKTEDTAVYYCVR<br>HGNFGNSPISYWAYWGQGTLVTVSSGGGGSGGGGSGGGGSQTVVTQEPSL<br>TVSPGGTVTLTCGSSTGAVVSGNYPNWVQQKPGQAPRGLIGGTEFLAPGT<br>PARFSGSLLGGKAALTLSGVQPEDEAEYYCVLWYSNRWVFGGGTKLTVL |
| 1898 | Anti-CD3, clone 2A4 | EVQLVESGGGLVQPGGSLKLSCAASGNTFNKYAMNWVRQAPGKGLEWVAR<br>IRSKYNNYATYYADSVKDRFTISRDDSKNTAYLQMNNLKTEDTAVYYCVR<br>HGNFGDSYISYWAYWGQGTLVTVSSGGGGSGGGGSGGGGSQTVVTQEPSL<br>TVSPGGTVTLTCGSSTGAVTHGNYPNWVQQKPGQAPRGLIGGTKVLAPGT<br>PARFSGSLLGGKAALTLSGVQPEDEAEYYCVLWYSNRWVFGGGTKLTVL |
| 1803 | Anti-CD3, clone 10B2 | EVQLVESGGGLVQPGGSLKLSCAASGFTFNNYAMNWVRQAPGKGLEWVAR<br>IRSGYNNYATYYADSVKDRFTISRDDSKNTAYLQMNNLKTEDTAVYYCVR<br>HGNFGNSYISYWAYWGQGTLVTVSSGGGGSGGGGSGGGGSQTVVTQEPSL<br>TVSPGGTVTLTCGSYTGAVTSGNYPNWVQQKPGQAPRGLIGGTKFNAPGT<br>PARFSGSLLGGKAALTLSGVQPEDEAEYYCVLWYANRWVFGGGTKLTVL |
| 1804 | Anti-CD3, clone 1G4 | EVQLVESGGGLVQPGGSLKLSCAASGFEFNKYAMNWVRQAPGKGLEWVAR<br>IRSKYNNYETYYADSVKDRFTISRDDSKNTAYLQMNNLKTEDTAVYYCVR<br>HGNFGNSLISYWAYWGQGTLVTVSSGGGGSGGGGSGGGGSQTVVTQEPSL<br>TVSPGGTVTLTCGSSSGAVTSGNYPNWVQQKPGQAPRGLIGGTKFGAPGT<br>PARFSGSLLGGKAALTLSGVQPEDEAEYYCVLWYSNRWVFGGGTKLTVL |

| SEQ ID NO: | Description | Sequence |
|---|---|---|
| 1805 | wt anti-CD3 | EVQLVESGGGLVQPGGSLKLSCAASGFTFNKYAMNWVRQAPGKGLEWVAR IRSKYNNYATYYADSVKDRFTISRDDSKNTAYLQMNNLKTEDTAVYYCVR HGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGT PARFSGSLLGGKAALTLSGVQPEDEAEYYCVLWYSNRWVFGGGTKLTVL |
| 1806 | Anti-CD3, clone 2G5 | EVQLVESGGGLVQPGGSLKLSCAASGFTFNKYALNWVRQAPGKGLEWVAR IRSKYNNYATEYADSVKDRFTISRDDSKNTAYLQMNNLKTEDTAVYYCVR HGNFGNSPISYWAYWGQGTLVTVSSGGGGSGGGGSGGGGSQTVVTQEPSL TVSPGGTVTLTCGSSTGAVTSGNYPNWVQQKPGQAPRGLIGGTNFLAPGT PERFSGSLLGGKAALTLSGVQPEDEAEYYCVLWYSNRWAFGGGTKLTVL |
| 1807 | Anti-CD3, clone 8A5 | EVQLVESGGGLVQPGGSLKLSCAASGFTFNEYAMNWVRQAPGKGLEWVAR IRSKYNNYATYYADDVKDRFTISRDDSKNTAYLQMNNLKTEDTAVYYCVR HGNFGNSGISYWAYWGQGTLVTVSSGGGGSGGGGSGGGGSQTVVTQEPSL TVSPGGTVTLTCGSSTGAVTVGNYPNWVQQKPGQAPRGLIGGTEFLAPGT PARFSGSLLGGKAALTLSGVQPEDEAEYYCVLWYSNRWVFGGGTKLTVL |

Linkers

| SEQ ID NO: | Description | AA Sequence |
|---|---|---|
| 1808 | Linker | GGGGSGGGS |
| 1809 | Linker | (GS)n |
| 1810 | Linker | (GGS)n |
| 1811 | Linker | (GGGS)n |
| 1812 | Linker | (GGSG)n |
| 1813 | Linker | (GGSGG)n |
| 1814 | Linker | (GGGGS)n |
| 1815 | Linker | (GGGGG)n |
| 1816 | Linker | (GGG)n |
| 1817 | Linker | (GGGGSGGGGSGGGGSGGGGS) |
| 1818 | Linker | GGGGSGGGGSGGGGS |
| 1819 | 6X Histidine | HHHHHH |

CD3 Binding Domain CDR Sequences

| SEQ ID NO: | CD3 Binding Domain CDR | Sequence |
|---|---|---|
| 1820 | HC CDR1 variant 1 | GNTFNKYAMN |
| 1821 | HC CDR1 variant 2 | GFEFNKYAMN |
| 1822 | HC CDR1 variant 3 | GFMFNKYAMN |
| 1823 | HC CDR1 variant 4 | GFTYNKYAMN |
| 1824 | HC CDR1 variant 5 | GFTFNNYAMN |
| 1825 | HC CDR1 variant 6 | GFTFNGYAMN |
| 1826 | HC CDR1 variant 7 | GFTFNTYAMN |
| 1827 | HC CDR1 variant 8 | GFTFNEYAMN |
| 1828 | HC CDR1 variant 9 | GFTFNKYPMN |

| | | |
|---|---|---|
| 1829 | HC CDR1 variant 10 | GFTFNKYAYN |
| 1830 | HC CDR1 variant 11 | GFTFNKYAIN |
| 1831 | HC CDR1 variant 12 | GFTFNKYALN |
| 1832 | HC CDR2 variant 1 | RIRSGYNNYATYYADSVK |
| 1833 | HC CDR2 variant 2 | RIRSKSNNYATYYADSVK |
| 1834 | HC CDR2 variant 3 | RIRSKYNKYATYYADSVK |
| 1835 | HC CDR2 variant 4 | RIRSKYNNYETYYADSVK |
| 1836 | HC CDR2 variant 5 | RIRSKYNNYATEYADSVK |
| 1837 | HC CDR2 variant 6 | RIRSKYNNYATYYKDSVK |
| 1838 | HC CDR2 variant 7 | RIRSKYNNYATYYADEVK |
| 1839 | HC CDR2 variant 8 | RIRSKYNNYATYYADAVK |
| 1840 | HC CDR2 variant 9 | RIRSKYNNYATYYADQVK |
| 1841 | HC CDR2 variant 10 | RIRSKYNNYATYYADDVK |
| 1842 | HC CDR3 variant 1 | HANFGNSYISYWAY |
| 1843 | HC CDR3 variant 2 | HTNFGNSYISYWAY |
| 1844 | HC CDR3 variant 3 | HGNFNNSYISYWAY |
| 1845 | HC CDR3 variant 4 | HGNFGDSYISYWAY |
| 1846 | HC CDR3 variant 5 | HGNFGNSHISYWAY |
| 1847 | HC CDR3 variant 6 | HGNFGNSPISYWAY |
| 1848 | HC CDR3 variant 7 | HGNFGNSQISYWAY |
| 1849 | HC CDR3 variant 8 | HGNFGNSLISYWAY |
| 1850 | HC CDR3 variant 9 | HGNFGNSGISYWAY |
| 1851 | HC CDR3 variant 10 | HGNFGNSYISYWAT |
| 1852 | LC CDR1 variant 1 | ASSTGAVTSGNYPN |
| 1853 | LC CDR1 variant 2 | GESTGAVTSGNYPN |
| 1854 | LC CDR1 variant 3 | GSYTGAVTSGNYPN |

| | | |
|---|---|---|
| 1855 | LC CDR1 variant 4 | GSSFGAVTSGNYPN |
| 1856 | LC CDR1 variant 5 | GSSKGAVTSGNYPN |
| 1857 | LC CDR1 variant 6 | GSSSGAVTSGNYPN |
| 1858 | LC CDR1 variant 7 | GSSTGYVTSGNYPN |
| 1859 | LC CDR1 variant 8 | GSSTGAVVSGNYPN |
| 1860 | LC CDR1 variant 9 | GSSTGAVTDGNYPN |
| 1861 | LC CDR1 variant 10 | GSSTGAVTKGNYPN |
| 1862 | LC CDR1 variant 11 | GSSTGAVTHGNYPN |
| 1863 | LC CDR1 variant 12 | GSSTGAVTVGNYPN |
| 1864 | LC CDR1 variant 13 | GSSTGAVTSGYYPN |
| 1865 | LC CDR2 variant 1 | GIKFLAP |
| 1866 | LC CDR2 variant 2 | GTEFLAP |
| 1867 | LC CDR2 variant 3 | GTYFLAP |
| 1868 | LC CDR2 variant 4 | GTSFLAP |
| 1869 | LC CDR2 variant 5 | GTNFLAP |
| 1870 | LC CDR2 variant 6 | GTKLLAP |
| 1871 | LC CDR2 variant 7 | GTKELAP |
| 1872 | LC CDR2 variant 8 | GTKILAP |
| 1873 | LC CDR2 variant 9 | GTKMLAP |
| 1874 | LC CDR2 variant 10 | GTKVLAP |
| 1875 | LC CDR2 variant 11 | GTKFNAP |
| 1876 | LC CDR2 variant 12 | GTKFGAP |
| 1877 | LC CDR2 variant 13 | GTKFLVP |
| 1878 | LC CDR3 variant 1 | TLWYSNRWV |
| 1879 | LC CDR3 variant 2 | ALWYSNRWV |
| 1880 | LC CDR3 variant 3 | VLWYDNRWV |

| | | |
|---|---|---|
| 1881 | LC CDR3 variant 4 | VLWYANRWV |
| 1882 | LC CDR3 variant 5 | VLWYSNSWV |
| 1883 | LC CDR3 variant 6 | VLWYSNRWI |
| 1884 | LC CDR3 variant 7 | VLWYSNRWA |
| 1890 | Exemplary anti-DLL3 trispecific protein (anti-CD3: anti-ALB: anti-DLL3 configuration) (CAT) | EVQLVESGGGLVQPGGSLKLSCAASGFTFNKYAINWVRQAPGKGLEWVARIRSKYNNYA TYYADQVKDRFTISRDDSKNTAYLQMNNLKTEDTAVYYCVRHANFGNSYISYWAYWGQG TLVTVSSGGGGSGGGGSGGGGSQTVVTQEPSLTVSPGGTVTLTCASSTGAVTSGNYPNW VQQKPGQAPRGLIGGTKFLVPGTPARFSGSLLGGKAALTLSGVQPEDEAEYYCTLWYSN RWVFGGGTKLTVLGGGGSGGGSEVQLVESGGGLVQPGNSLRLSCAASGFTFSKFGMSWV RQAPGKGLEWVSSISGSGRDTLYADSVKGRFTISRDNAKTTLYLQMNSLRPEDTAVYYC TIGGSLSVSSQGTLVTVSSGGGGSGGGSEVQLVESGGGLVQPGGSLTLSCAASSSSVSL LSLAWYRQAPGKKRELVAGISDDGSIVYMDSVKGRFTISRDNAKNSVYLQMNSLRAEDT AVYYCYAYSWITRSPYWGQGTLVTVSSHHHHHH |
| 1891 | Exemplary anti-DLL3 trispecific Protein (anti-DLL3 anti-: ALB: anti-CD3 configuration) (TAC) | EVQLVESGGGLVQPGGSLTLSCAASSSSVSLLSLAWYRQAPGKKRELVAGISDDGSIVY MDSVKGRFTISRDNAKNSVYLQMNSLRAEDTAVYYCYAYSWITRSPYWGQGTLVTVSSG GGGSGGGSEVQLVESGGGLVQPGNSLRLSCAASGFTFSKFGMSWVRQAPGKGLEWVSSI SGSGRDTLYADSVKGRFTISRDNAKTTLYLQMNSLRPEDTAVYYCTIGGSLSVSSQGTL VTVSSGGGGSGGGSEVQLVESGGGLVQPGGSLKLSCAASGFTFNKYAINWVRQAPGKGL EWVARIRSKYNNYATYYADQVKDRFTISRDDSKNTAYLQMNNLKTEDTAVYYCVRHANF GNSYISYWAYWGQGTLVTVSSGGGGSGGGGSGGGGSQTVVTQEPSLTVSPGGTVTLTCA SSTGAVTSGNYPNWVQQKPGQAPRGLIGGTKFLVPGTPARFSGSLLGGKAALTLSGVQP EDEAEYYCTLWYSNRWVFGGGTKLTVLHHHHHH |

DLL3 Protein UniProtKB Accession Q9NYJ7 (SEQ ID NO: 1885)
>sp|Q9NYJ7|DLL3_HUMAN Delta-like protein 3 OS = Homo sapiens OX = 9606 GN = DLL3 PE = 1
SV = 1
MVSPRMSGLLSQTVILALIFLPQTRPAGVFELQIHSFGPGPGPAPRSPCSARLPCRLFF
RVCLKPGLSEEAAESPCALGAALSARGPVYTEQPGAPAPDLPLPDGLLQVPFRDAWPGTF
SFIIETWREELGDQIGGPAWSLLARVAGRRRLAAGGPWARDIQRAGAWELRFSYRARCEP
PAVGTACTRLCRPRSAPSRCGPGLRPCAPLEDECEAPLVCRAGCSPEHGFCEQPGECRCL
EGWTGPLCTVPVSTSSCLSPRGPSSATTGCLVPGPGPCDGNPCANGGSCSETPRSFECTC
PRGFYGLRCEVSGVTCADGPCFNGGLCVGGADPDSAYICHCPPGFQGSNCEKRVDRCSLQ
PCRNGGLCLDLGHALRCRCRAGFAGPRCEHDLDDCAGRACANGGTCVEGGGAHRCSCALG
FGGRDCRERADPCAARPCAHGGRCYAHFSGLVCACAPGYMGARCEFPVHPDGASALPAAP
PGLRPGDPQRYLLPPALGLLVAAGVAGAALLLVHVRRRGHSQDAGSRLLAGTPEPSVHAL
PDALNNLRTQEGSGDGPSSSVDWNRPEDVDPQGIYVISAPSIYAREVATPLFPPLHTGRA
GQRQHLLFPYPSSILSVK 51X5 (SEQ ID NO: 1886)
EVQLVESGGGLVQPGGSLTLSCAASLSSVSVLSIAWYRQAPGKKRELVAGISTDGSTVYIDSVKGRFTISRDNAKNSVYL
QMNSLRAEDTAVYYCYAYSWTTSLPYWGQGTLVTVSS

51X5 CDR1 (SEQ ID NO: 1887)
LSSVSVLSIA

51X5 CDR2 (SEQ ID NO: 1888)
GISTDGSTVYIDSVKG

51X5 CDR3 (SEQ ID NO: 1889)
YSWTTSLPY

>NP_058637.1 delta-like protein 3 isoform 1 precursor [Homo sapiens](SEQ ID No.
1892)
MVSPRMSGLLSQTVILALIFLPQTRPAGVFELQIHSFGPGPGPAPRSPCSARLPCRLFFRVCLKPGLSE
EAAESPCALGAALSARGPVYTEQPGAPAPDLPLPDGLLQVPFRDAWPGTFSFIIETWREELGDQIGGPAW
SLLARVAGRRRLAAGGPWARDIQRAGAWELRFSYRARCEPPAVGTACTRLCRPRSAPSRCGPGLRPCAPL
EDECEAPLVCRAGCSPEHGFCEQPGECRCLEGWTGPLCTVPVSTSSCLSPRGPSSATTGCLVPGPGPCDG
NPCANGGSCSETPRSFECTCPRGFYGLRCEVSGVTCADGPCFNGGLCVGGADPDSAYICHCPPGFQGSNC
EKRVDRCSLQPCRNGGLCLDLGHALRCRCRAGFAGPRCEHDLDDCAGRACANGGTCVEGGGAHRCSCALG
FGGRDCRERADPCAARPCAHGGRCYAHFSGLVCACAPGYMGARCEFPVHPDGASALPAAPPGLRPGDPQR
YLLPPALGLLVAAGVAGAALLLVHVRRRGHSQDAGSRLLAGTPEPSVHALPDALNNLRTQEGSGDGPSSS
VDWNRPEDVDPQGIYVISAPSIYAREVATPLFPPLHTGRAGQRQHLLFPYPSSILSVK DLL3 Protein Sequence (SEQ ID NO: 1893)
RSPCSARLPCRLFFRVCLKPGLSEEAAESPCALGAALSARGPVYTEQPGAPAPDLPLPDGLLQVPFRDAWPGTFSFIIET
WREELGDQIGGPAWSLLARVAGRRRLAAGGPWARDIQRAGAWELRFSYRARCEPPAVGTACTRLCRPRSAPSRCGPGLRP
CAPLEDECEAPLVCRAGCSPEHGFCEQPGECRCLEGWTGPLCTVPVSTSSCLSPRGPSSATTGCLVPGPGPCDGNPCANG
GSCSETPRSFECTCPRGFYGLRCEVSGVTCADGPCFNGGLCVGGADPDSAYICHCPPGFQGSNCEKRVDRCSLQPCRNGG -continued

```
LCLDLGHALRCRCRAGFAGPRCEHDLDDCAGRACANGGTCVEGGGAHRCSCALGFGGRDCRERADPCAARPCAHGGRCYA
HFSGLVCACAPGYMGARCEFPVHPDGASALPAAPPGLRPGDPQRYL
```

SEQUENCE LISTING (1898 sequences)

SEQ ID NO: 1 - protein, 115 aa, Artificial Sequence
  Description of Artificial Sequence: Synthetic polypeptide
QVQLQESGGGLVQAGGSLRLSCAASGSIFSIASMGWYRQAPGKQRELVAVITSFSSTNYADSVKGRFTISRDNAKNTVYLQMNSLKPEDTGVYYCNARYFERTDWGQGTQVTVSS

SEQ ID NO: 2 - protein, 115 aa, Artificial Sequence
  Description of Artificial Sequence: Synthetic polypeptide
QVQLQESGGGLVQAGGSLRLSCAAPGSIFSIASMGWYRQAPGKQRELVAVITSFSSTNYADSVKGRFTISRDNAKNTVYLQMNSLKPEDTGVYYCNARYFERTDWGQGTQVTVSS

SEQ ID NO: 3 - protein, 115 aa, Artificial Sequence
  Description of Artificial Sequence: Synthetic polypeptide
QVQLQESGGGLVQAGGSLRLSCAASGSIFSIASMAWYRQAPGKQRELVAAITSFSSTNYADSVKGRFTISRDNAKNTVYLQMNSLKPEDTGVYYCNARYFERTDWGQGTQVTVSS

SEQ ID NO: 4 - protein, 115 aa, Artificial Sequence
  Description of Artificial Sequence: Synthetic polypeptide
QVQLQESGGGLVQAGGSLRLSCAASESIFSINVMAWHRQAPGKQRELVARITSGGSTNYADSVKGRFTISRDNAKNTVYLQMNSLKPEDTGVYYCGAYQGLYAYWGQGTQVTVSS

SEQ ID NO: 5 - protein, 115 aa, Artificial Sequence
  Description of Artificial Sequence: Synthetic polypeptide
QVQLQESGGGLVQAGGSLRLSCVASGSSFSITSMAWYRQAPGKQRDLVAAITSFGSTNYADSVKDRFTISRDNAKNTVYLQMNSLKPEDTAVYYCNGRVFDHVYWGQGTQVTVSS

SEQ ID NO: 6 - protein, 115 aa, Artificial Sequence
  Description of Artificial Sequence: Synthetic polypeptide
QVQLQESGGGLVQAGGSLKLSCAASSSIFSISSMSWYRQAPGKQRELVAAITTFDYTNYADSVKGRFTISRDNAKNMMYLQMNSLKPEDTAVYLCNARAFGRDYWGQGTQVTVSS

SEQ ID NO: 7 - protein, 115 aa, Artificial Sequence
  Description of Artificial Sequence: Synthetic polypeptide
QVQLQESGGGLVQAGGSLKLSCAASSSIFSISSMSWYRQAPGKQRELVAAITSFGSTNYADSVKGRFTISRDNAKNMMYLQMNSLKPEDTAVYRCNARTMGRDYWGQGTQVTVSS

SEQ ID NO: 8 - protein, 116 aa, Artificial Sequence
  Description of Artificial Sequence: Synthetic polypeptide
QVQLQESGGGLVQPGGSLRLSCAASGSTLNIKIMAWHRQAPGKQRELVATLTSGGNTNYADSVKGRFTISRDNAKNTVYLQMNSLQPEDTAVYYCGLWDGVGGAYWGRGTQVTVSS

SEQ ID NO: 9 - protein, 116 aa, Artificial Sequence
  Description of Artificial Sequence: Synthetic polypeptide
QVQLQESGGGLVQPGGSLRISCAASGSTLNIKIMAWHRQAPGKQRELVATLTSGGNTNYADSVKGRFTISRDNAKNTVYLQMNSLQPEDTAVYYCGLWDGVGGAYWGRGTQVTVSS

SEQ ID NO: 10 - protein, 116 aa, Artificial Sequence
  Description of Artificial Sequence: Synthetic polypeptide
QVQLQESGGGLVQAGGSLRLSCAASGSTFNIKTMAWHRQAPGNQRELVATLTSGGNTNYADSVKGRFTISRDNAKNTVYLQMNSLKPEDTAVYYCGLWNGVGGAYWGRGTQVTVSS

SEQ ID NO: 11 - protein, 115 aa, Artificial Sequence
  Description of Artificial Sequence: Synthetic polypeptide
QVQLQDGGGLVQPGGSLRLSCAASGSTFNIKLMAWHRQAPGNQRELVATLTSGGNTNYADSVKGRFTISRDNASNIVYLQMNSLKPEDTAVYYCGLWDGVGGAYWGRGTQVTVSS

SEQ ID NO: 12 - protein, 116 aa, Artificial Sequence
  Description of Artificial Sequence: Synthetic polypeptide
QVQLQESGGGLVQAGGSLRLSCAASGSTFNFKIMAWHRQAPGKQRELVASLTSEGLTNYRDSVKGRFTISRDNAKNTVYLQMNNLKPEDTAVYYCGLWDGVGGAYWGRGTQVTVSS

SEQ ID NO: 13 - protein, 114 aa, Artificial Sequence
  Description of Artificial Sequence: Synthetic polypeptide
QVQLQESGGGLVQPGGSLRLSCAASGFMFSSYSMSWYRQAPGKQRELVAAITTWGSTNYADSVKGRFTISRDNAKNTVWLQMNSLEPEDTAVYFCNARSWNNYWGQGTQVTVSS

SEQ ID NO: 14 - protein, 114 aa, Artificial Sequence
  Description of Artificial Sequence: Synthetic polypeptide
QVQLQESGGGLVQVGGSLRLSCAASGFMFSSYSMSWYRQAPGKQRELVAAITSYGSTNYADSVKGRFTISRDNAKNTVWLQMNSLKPEDTAVYFCNARSWNNYWGQGTQVTVSS

SEQ ID NO: 15 - protein, 114 aa, Artificial Sequence
  Description of Artificial Sequence: Synthetic polypeptide
QVQLQESGGGLVQPGGSLRLSCAASGFTFSSHSMSWYRQAPGKQRELVAAITTYGSTNYIDSVKGRFTISRDNTKNTVYLQMNSLKPEDTAVYFCNARSWNNYWGQGTQVTVSS

SEQ ID NO: 16 - protein, 117 aa, Artificial Sequence
  Description of Artificial Sequence: Synthetic polypeptide
QVQLQESGGGLVQAGGSLRLSCVASGSSFSHNTMGWYRQAPGKQRDLVARITTFGTTNYADSVKGRFTISRDNAKNTVYLQMNSLKPEDTAVYYCNGESFGRIWYNWGQGTQVTVSS

SEQ ID NO: 17 - protein, 116 aa, Artificial Sequence
  Description of Artificial Sequence: Synthetic polypeptide
QVQLQESGGGLVQAGASLRLTCTASGGRFSYATMGWSRQAPGKQREMVARITSSGFSTNYADSVKGRFTISRDNAKNAVYLQMDSLKPEDTAVYYCNAQHFGTDSWGQGTQVTVSS

SEQ ID NO: 18 - protein, 116 aa, Artificial Sequence
  Description of Artificial Sequence: Synthetic polypeptide
QVQLQESGGGLVQAGASLRLTCTASGSRFSYATMGWSRQAPGKQRELVARITSSGFSTNYADSVKGRFTISRDNAKNAVYLQMDSLKPEDTAVYYCNAQQFGTDSWGQGTQVTVSS

SEQ ID NO: 19 - protein, 117 aa, Artificial Sequence
  Description of Artificial Sequence: Synthetic polypeptide
QVQLQESGGGLVQAGGSLRLSCAASGSTFTSNVMGWHRQAPGKQRELVANMHSGGSTNYADSVKGRFTISRDNAKNIVYLQMNNLKIEDTAVYYCRWYGIQRAEGYWGQGTQVTVSS

SEQ ID NO: 20 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISVDGSTNYADSVKGRFTVSRDNAKNTVYLQMNSLQPEDTAVYYCYAYRWVGRDTYWGQGTQVTVSS

SEQ ID NO: 21 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISVDGSTNYADSVKGRFTISRDNAKNTVYLQMNSLQPEDTAVYYCYAYRWVGRDTYWGQGTQVTVSS

SEQ ID NO: 22 - protein, 117 aa, Artificial Sequence
  Description of Artificial Sequence: Synthetic polypeptide
QVQLQESGGGLVVSGGSLRLSCAASGSSVSFLSMAWYRQAPGKKRELVAGISVDGSTNYADSVKGRFTISRDNAKNTVYLQMNSLQPEDTAAYYCYAYRWVGRDTYWGQGTQVTVSS

SEQ ID NO: 23 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISVDGSTNYADSVKGRFTISRDNAENTVYLQMNSLQPEDTAVYYCYAYRWEGRDTYWGQGTQVTVSS

SEQ ID NO: 24 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISVDGSTNYADSVKGRFTISRDNAENTVYLQMNSLQPEDTAVYYCYAYRWEGRNTYWGQGTQVTVSS

SEQ ID NO: 25 - protein, 117 aa, Artificial Sequence
  Description of Artificial Sequence: Synthetic polypeptide
QVQLQESGGGLVQPGGSLRLSCAASGSSVSFLSMAWYRQAPGKKRELVAGISTDGSTNYVDSVKGRFTISRDNAKNTVYLQMNSLQPEDTAVYYCYAYRWVGRYTYWGQGTQVTVSS

SEQ ID NO: 26 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISTDGTTNYVDSVKDRFTISRDNAKNTVYLQMNSLQPEDTAAYYCYAYRWVGRDTYWGQGTQVTVSS

SEQ ID NO: 27 - protein, 117 aa, Artificial Sequence
  Description of Artificial Sequence: Synthetic polypeptide
QVQLQESGGGLVVAGGSLRLSCAASGSSVSFLSIAWYRQAPGKKRELVAGISTDGTTNYVDSVKDRFTISRDNAKNTVYLQMNSLQPEDTAAYYCYAYRWVGRDTYWGQGTQVTVSS

SEQ ID NO: 28 - protein, 117 aa, Artificial Sequence
  Description of Artificial Sequence: Synthetic polypeptide
QVQLQESGGGLVQAGGSLTLSCAASGSSVSFLSMAWYRQAPGKKRELVAGISTDGTTNYVDSVKDRFTISRDNAKNTVYLQMNSLQPEDTAAYYCYAYRWVGRDTYWGQGTQVTVSS

SEQ ID NO: 29 - protein, 117 aa, Artificial Sequence
  Description of Artificial Sequence: Synthetic polypeptide
QVQLQESGGGLVQAGGSLRLSCAASGSSVSFLSMAWYRQAPGKKRELVAGISTDGSTNYADSVKGRFTISEGNAKNTVDLQMNSLQPEDTAVYYCYAYRWVDRYTYWGQGTQVTVSS

SEQ ID NO: 30 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISTDGSTNYADSVKGRFTISEDNAKNTVDLQMNSLQPEDTAVYYCYAYRWIDRYTYWGQGTQVTVSS

SEQ ID NO: 31 - protein, 117 aa, Artificial Sequence
  Description of Artificial Sequence: Synthetic polypeptide
QVQLQESGGGLVQPGGSLRLSCAASGSSVSFLSMAWYRQAPGKKRELVAGISTDGSTNYADSVKGRFTISEDNAKNTVDLQMNSLQPEDTAVYYCYAYRWVDRYTYWGQGTQVTVSS

SEQ ID NO: 32 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISSDGSTNYVDSVKGRFTISRDNAKNIVFLQMNSLQPQDTAVYYCYAYRWVGRDTYWGQGTQVTVSS

SEQ ID NO: 33 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISADGSTDYIDSVKGRFTISRDSANNTMYLQMNSLQPEDTAVYYCYAYRWTTRYTYWGQGTQVTVSS

SEQ ID NO: 34 - protein, 117 aa, Artificial Sequence
  Description of Artificial Sequence: Synthetic polypeptide
QVQLQESGGGLVQPGGSLRLSCAASGFTLDYYAIGWYRQAPGKKRELVAGISSDGSTHYVDSVKGRFAISRDNAENTVYLQMNDLQPDDTAVYYCYAYRWVGGYTYWGQGTQVTVSS

SEQ ID NO: 35 - protein, 119 aa, Artificial Sequence
  Description of Artificial Sequence: Synthetic polypeptide
QVQLQESGGGLVQAGGSLRLSCVASGSTSSINAMGWYRRAPGKQRELVAGISSDGSKNYADSVKGRFTISRDNAKNTVYLQMNSLKPEDTAVYYCYYFRTVAASSMQYWGQGTQVTVSS

SEQ ID NO: 36 - protein, 119 aa, Artificial Sequence
  Description of Artificial Sequence: Synthetic polypeptide
QVQLQESGGGLVQAGGSLRLSCVASGSTSSINAMGWYRRAPGKQRELVAGISSDGSKVYADSVKGRFTISRDNAKNTVYLQMNSLKPEDTAVFYCYYFRTVSGSSMRYWGQGTQVTVSS

SEQ ID NO: 37 - protein, 118 aa, Artificial Sequence
  Description of Artificial Sequence: Synthetic polypeptide
QVQLQESGGGLVQAGGSLRLSCAASGITSSVYSMGWYRQAPGKQRELVAGSSSDGSTHYVDSVRGRFTISRDNAKNTVYLQMSSLKPEDTAVYYCYANRGFAGAPSYWGQGTQVTVSS

SEQ ID NO: 38 - protein, 114 aa, Artificial Sequence
  Description of Artificial Sequence: Synthetic polypeptide
QVQLQESGGGLVQAGGSLRLSCAASGRTSMFNSMGWHRQAPGKQRELVAIIRSGGSSNYADTVKGRFTISRDNTKNTVYLQMNDLKPEDTAVYYCFYYFQSSYWGQGTQVTVSS

SEQ ID NO: 39 - protein, 114 aa, Artificial Sequence
  Description of Artificial Sequence: Synthetic polypeptide
QVQLQESGGGLVQAGGSLRLSCAASGRTSMVNSMGWHRQAPGKQRELVALITSGGSSNYADTVKGRFTISRDNTKNTVYLQMNDLKPEDTAVYYCFYYFQSSYWGQGTQVTVSS

SEQ ID NO: 40 - protein, 114 aa, Artificial Sequence
  Description of Artificial Sequence: Synthetic polypeptide
QVQLQESGGGLVQAGGSLRLSCAASGSVSMFNSMGWHRQPPGKQRELVAIITSGGSSNYADTVKGRFTISRDNTKNTVYLQMNDLKPEDTAVYYCFYYFQSSYWGQGTQVTVSS

SEQ ID NO: 41 - protein, 119 aa, Artificial Sequence
  Description of Artificial Sequence: Synthetic polypeptide
QVQLQESGGGLVQAGGSLRLSCTASGSIFSIAVMGWYRQVPGKRREWVATIFDGSYTNYADSVKGRFTISRDNARNKVYLQMNNLKPEDTAVYYCQTHWTQGSVPKESWGQGTQVTVSS

SEQ ID NO: 42 - protein, 115 aa, Artificial Sequence
  Description of Artificial Sequence: Synthetic polypeptide
QVQLQESGGGLVQAGGSLRLSCVASSGIFSDMSMVWYRQAPGKQRELVASITTFGSTNYADPVKGRFTISRDNAKNTVYLQMNSLKPEDTAVYYCSGRSYSSDYWGRGTQVTVSS

SEQ ID NO: 43 - protein, 115 aa, Artificial Sequence
  Description of Artificial Sequence: Synthetic polypeptide
QVQLQESGGGLVQAGGSLRLSCVASGSISSIIVMGWSRQAPGKQRESVATITRDGTRNYADSLKGRFTISRDNAKNTSYLQINSLKPEDTAVYSCYARYGDINYWGKGTQVTVSS

SEQ ID NO: 44 - protein, 115 aa, Artificial Sequence
  Description of Artificial Sequence: Synthetic polypeptide
QVQLQESGGGLVQAGGSLRLSCVASGSISSIIVMGWSRQAPGKQRESLATISRGGTRTYADSVKGRFTISRDNAKNTSYLQMNSLKPEDTAVYSCYARYGDINYWGKGTQVTVSS

SEQ ID NO: 45 - protein, 114 aa, Artificial Sequence
  Description of Artificial Sequence: Synthetic polypeptide
QVQLQESGGGLVQAGGSLRLSCVASGSIFTTNSMGWHRQGPGKQRELVALIGSAGSTKYADSVKGRFTISRDNAKNTVSLQMDSLKPEDTAVYYCFYYDSRSYWGQGTQVTVSS

SEQ ID NO: 46 - protein, 114 aa, Artificial Sequence
  Description of Artificial Sequence: Synthetic polypeptide
QVQLQESGGGMVQPGGSLRLSCAASGSREISTMGWHRQAPGKQRELAARITSGGITKYADSVKGRFTISRDNAKKTVYLQMNSLKSEDTAVYYCFAYDNINAYWGQGTQVTVSS

SEQ ID NO: 47 - protein, 114 aa, Artificial Sequence
  Description of Artificial Sequence: Synthetic polypeptide
QVQLQESGGGWVQAGGSLRLSCAASGSREISTMGWHRQAPGKQRELAARITSGGITKYADSVKGRFTISRDNAKKTVYLQMNSLKSEDTAVYYCFAYDNINAYWGQGTQVTVSS

SEQ ID NO: 48 - protein, 114 aa, Artificial Sequence
  Description of Artificial Sequence: Synthetic polypeptide
QVQLQESGGGWVQAGGSLRLSCTASGSREISTMGWHRQAPGKQRELAARITSGGITKYADSVKGRFTISRDNAKKTVYLQMDSLKSEDTAVYYCFAYDNINAYWGQGTQVTVSS

SEQ ID NO: 49 - protein, 114 aa, Artificial Sequence
  Description of Artificial Sequence: Synthetic polypeptide
QVQLQESGGGSVQAGRSLGLSCAASGSREISTMGWHRQAPGKQRELAARITSGGITKYADSVKGRFTISRDNAKKTVYLQMNSLKSEDTAVYYCFAYDNINAYWGQGTQVTVSS

SEQ ID NO: 50 - protein, 115 aa, Artificial Sequence
  Description of Artificial Sequence: Synthetic polypeptide
QVQLQESGGGLVQAGGSLRLSCTASGSIFRGAAMYWHRQAPGKQRELVAAITTSGNTSYADSVKGRFTISRDNAKNTMYLQIISLKPEDTAVYYCAFWIAGKAYWGQGTQVTVSS

SEQ ID NO: 51 - protein, 115 aa, Artificial Sequence
  Description of Artificial Sequence: Synthetic polypeptide
QVQLQESGGGLVQPGGSLRLSCAASGSISSFNFMSWHRQAPGKERELAGVITRGGATNYADSVKGRFTISRDNVKNTVYLQMNGLKPEDTAVYYCHGRSQLGSTWGQGTQVTVSS

SEQ ID NO: 52 - protein, 116 aa, Artificial Sequence
  Description of Artificial Sequence: Synthetic polypeptide
QVQLQESGGGLVQAGGSLRLSCLASGTIFTASTMGWHRQPPGKQRELVASIAGDGRTNYAESTEGRFTISRDDAKNTMYLQMNSLKPEDTAVYYCYAYYLDTYAYWGQGTQVTVSS

SEQ ID NO: 53 - protein, 115 aa, Artificial Sequence
  Description of Artificial Sequence: Synthetic polypeptide
EVQLVESGGGLVQPGGSLTLSCAASGSIFSIASMGWYRQAPGKQRELVAVITSFSSTNYADSVKGRFTISRDNAKNSVYLQMNSLRAEDTAVYYCNARYFERTDWGQGTLVTVSS

SEQ ID NO: 54 - protein, 114 aa, Artificial Sequence
  Description of Artificial Sequence: Synthetic polypeptide
EVQLVESGGGLVQPGGSLTLSCAASGRTSMFNSMGWHRQAPGKQRELVAIIRSGGSSNYADTVKGRFTISRDNAKNSVYLQMNSLRAEDTAVYYCFYYFQSSYWGQGTLVTVSS

SEQ ID NO: 55 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISVDGSTNYADSVKGRFTISRDNAKNSVYLQMNSLRAEDTAVYYCYAYRWVGRDTYWGQGTLVTVSS

SEQ ID NO: 56 - protein, 115 aa, Artificial Sequence
  Description of Artificial Sequence: Synthetic polypeptide
EVQLVESGGGLVQPGGSLTLSCTASGSIFRGAAMYWHRQAPGKQRELVAAITTSGNTSYADSVKGRFTISRDNAKNSMYLQMNSLRAEDTAVYYCAFWIAGKAYWGQGTLVTVSS

SEQ ID NO: 57 - protein, 116 aa, Artificial Sequence
  Description of Artificial Sequence: Synthetic polypeptide
EVQLVESGGGLVQPGGSLTLSCAASGSTFNIKTMAWHRQAPGNQRELVATLTSGGNTNYADSVKGRFTISRDNAKNSVYLQMNSLRAEDTAVYYCGLWNGVGGAYWGQGTLVTVSS

SEQ ID NO: 58 - protein, 116 aa, Artificial Sequence
  Description of Artificial Sequence: Synthetic polypeptide
EVQLVESGGGLVQPGGSLTLSCAASGSTLNIKIMAWHRQAPGKQRELVATLTSGGNTNYADSVKGRFTISRDNAKNSVYLQMNSLRAEDTAVYYCGLWDGVGGAYWGQGTLVTVSS

SEQ ID NO: 59 - protein, 115 aa, Artificial Sequence
  Description of Artificial Sequence: Synthetic polypeptide
EVQLVESGGGLVQPGGSLTLSCAASSSIFSISSMSWYRQAPGKQRELVAAITTFDYTNYADSVKGRFTISRDNAKNSMYLQMNSLRAEDTAVYYCNARAFGRDYWGQGTLVTVSS

SEQ ID NO: 60 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKNYADSVKGRFTISRDNAKNSVYLQMNSLRAEDTAVYYCYYFRTVAASSMQYWGQGTLVTVSS

SEQ ID NO: 61 - protein, 114 aa, Artificial Sequence
  Description of Artificial Sequence: Synthetic polypeptide
EVQLVESGGGLVQPGGSLTLSCAASGFMFSSYSMSWYRQAPGKQRELVAAITSYGSTNYADSVKGRFTISRDNAKNSVYLQMNSLRAEDTAVYYCNARSWNNYWGQGTLVTVSS

SEQ ID NO: 62 - protein, 114 aa, Artificial Sequence
  Description of Artificial Sequence: Synthetic polypeptide
EVQLVESGGGLVQPGGSLTLSCAASGSVSMFNSMGWHRQPPGKQRELVAIITSGGSSNYADTVKGRFTISRDNAKNSVYLQMNSLRAEDTAVYYCFYYFQSSYWGQGTLVTVSS

SEQ ID NO: 63 - protein, 116 aa, Artificial Sequence
  Description of Artificial Sequence: Synthetic polypeptide
EVQLVESGGGLVQPGGSLTLSCTASGGRFSYATMGWSRQAPGKQREMVARITSSGFSTNYADSVKGRFTISRDNAKNSVYLQMNSLRAEDTAVYYCNAQHFGTDSWGQGTLVTVSS

SEQ ID NO: 64 - protein, 115 aa, Artificial Sequence
  Description of Artificial Sequence: Synthetic polypeptide
EVQLVESGGGLVQPGGSLTLSCAASGSISSFNFMSWHRQAPGKERELAGVITRGGATNYADSVKGRFTISRDNAKNSVYLQMNSLRAEDTAVYYCHGRSQLGSTWGQGTLVTVSS

SEQ ID NO: 65 - protein, 115 aa, Artificial Sequence
  Description of Artificial Sequence: Synthetic polypeptide
EVQLVESGGGLVQPGGSLTLSCAASESIFSINVMAWHRQAPGKQRELVARITSGGSTNYADSVKGRFTISRDNAKNSVYLQMNSLRAEDTAVYYCGAYQGLYAYWGQGTLVTVSS

SEQ ID NO: 66 - protein, 114 aa, Artificial Sequence
  Description of Artificial Sequence: Synthetic polypeptide
EVQLVESGGGLVQPGGSLTLSCAASGSREISTMGWHRQAPGKQRELAARITSGGITKYADSVKGRFTISRDNAKNSVYLQMNSLRAEDTAVYYCFAYDNINAYWGQGTLVTVSS

SEQ ID NO: 67 - protein, 119 aa, Artificial Sequence
  Description of Artificial Sequence: Synthetic polypeptide
EVQLVESGGGLVQPGGSLTLSCTASGSIFSIAVMGWYRQVPGKRREWVATIFDGSYTNYADSVKGRFTISRDNAKNSVYLQMNSLRAEDTAVYYCQTHWTQGSVPKESWGQGTLVTVSS

SEQ ID NO: 68 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYADSVKGRFTISRDNAKNSVYLQMNSLRAEDTAVYYCYYFRTVSGSSMRYWGQGTLVTVSS

SEQ ID NO: 69 - protein, 115 aa, Artificial Sequence
  Description of Artificial Sequence: Synthetic polypeptide
EVQLVESGGGLVQPGGSLTLSCVASSGIFSDMSMVWYRQAPGKQRELVASITTFGSTNYADPVKGRFTISRDNAKNSVYLQMNSLRAEDTAVYYCSGRSYSSDYWGQGTLVTVSS

SEQ ID NO: 70 - protein, 114 aa, Artificial Sequence
  Description of Artificial Sequence: Synthetic polypeptide
EVQLVESGGGLVQPGGSLTLSCAASGFMFSSYSMSWYRQAPGKQRELVAAITTWGSTNYADSVKGRFTISRDNAKNSVYLQMNSLRAEDTAVYYCNARSWNNYWGQGTLVTVSS

SEQ ID NO: 71 - protein, 116 aa, Artificial Sequence
  Description of Artificial Sequence: Synthetic polypeptide
EVQLVESGGGLVQPGGSLTLSCTASGSRFSYATMGWSRQAPGKQRELVARITSSGFSTNYADSVKGRFTISRDNAKNSVYLQMNSLRAEDTAVYYCNAQQFGTDSWGQGTLVTVSS

SEQ ID NO: 72 - protein, 117 aa, Artificial Sequence
  Description of Artificial Sequence: Synthetic polypeptide
EVQLVESGGGLVQPGGSLTLSCAASGSTFTSNVMGWHRQAPGKQRELVANMHSGGSTNYADSVKGRFTISRDNAKNSVYLQMNSLRAEDTAVYYCRWYGIQRAEGYWGQGTLVTVSS

SEQ ID NO: 73 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISTDGSTNYVDSVKGRFTISRDNAKNSVYLQMNSLRAEDTAVYYCYAYRWVGRYTYWGQGTLVTVSS

SEQ ID NO: 74 - protein, 115 aa, Artificial Sequence
  Description of Artificial Sequence: Synthetic polypeptide
EVQLVESGGGLVQPGGSLTLSCVASGSISSIIVMGWSRQAPGKQRESVATITRDGTRNYADSLKGRFTISRDNAKNSSYLQMNSLRAEDTAVYYCYARYGDINYWGQGTLVTVSS

SEQ ID NO: 75 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTDYIDSVKGRFTISRDNAKNSVYLQMNSLRAEDTAVYYCYAYRWTTRYTYWGQGTLVTVSS

SEQ ID NO: 76 - protein, 116 aa, Artificial Sequence
  Description of Artificial Sequence: Synthetic polypeptide
EVQLVESGGGLVQPGGSLTLSCLASGTIFTASTMGWHRQPPGKQRELVASIAGDGRTNYAESTEGRFTISRDNAKNSMYLQMNSLRAEDTAVYYCYAYYLDTYAYWGQGTLVTVSS

SEQ ID NO: 77 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISVDGSTNYADSVKGRFTISRDNAKNSVYLQMNSLRAEDTAVYYCYAYRWEGRNTYWGQGTLVTVSS

SEQ ID NO: 78 - protein, 117 aa, Artificial Sequence
  Description of Artificial Sequence: Synthetic polypeptide
EVQLVESGGGLVQPGGSLTLSCVASGSSFSHNTMGWYRQAPGKQRDLVARITTFGTTNYADSVKGRFTISRDNAKNSVYLQMNSLRAEDTAVYYCNGESFGRIWYNWGQGTLVTVSS

SEQ ID NO: 79 - protein, 115 aa, Artificial Sequence
  Description of Artificial Sequence: Synthetic polypeptide
EVQLVESGGGLVQPGGSLTLSCVASGSISSIIVMGWSRQAPGKQRESLATISRGGTRTYADSVKGRFTISRDNAKNSSYLQMNSLRAEDTAVYYCYARYGDINYWGQGTLVTVSS

SEQ ID NO: 80 - protein, 115 aa, Artificial Sequence
  Description of Artificial Sequence: Synthetic polypeptide
EVQLVESGGGLVQPGGSLTLSCVASGSSFSITSMAWYRQAPGKQRDLVAAITSFGSTNYADSVKDRFTISRDNAKNSVYLQMNSLRAEDTAVYYCNGRVFDHVYWGQGTLVTVSS

SEQ ID NO: 81 - protein, 114 aa, Artificial Sequence
  Description of Artificial Sequence: Synthetic polypeptide
EVQLVESGGGLVQPGGSLTLSCAASGRTSMVNSMGWHRQAPGKQRELVALITSGGSSNYADTVKGRFTISRDNAKNSVYLQMNSLRAEDTAVYYCFYYFQSSYWGQGTLVTVSS

SEQ ID NO: 82 - protein, 116 aa, Artificial Sequence
  Description of Artificial Sequence: Synthetic polypeptide
EVQLVESGGGLVQPGGSLTLSCAASGSTFNFKIMAWHRQAPGKQRELVASLTSEGLTNYRDSVKGRFTISRDNAKNSVYLQMNSLRAEDTAVYYCGLWDGVGGAYWGQGTLVTVSS

SEQ ID NO: 83 - protein, 117 aa, Artificial Sequence
  Description of Artificial Sequence: Synthetic polypeptide
EVQLVESGGGLVQPGGSLTLSCAASGFTLDYYAIGWYRQAPGKKRELVAGISSDGSTHYVDSVKGRFTISRDNAKNSVYLQMNSLRAEDTAVYYCYAYRWVGGYTYWGQGTLVTVSS

SEQ ID NO: 84 - protein, 114 aa, Artificial Sequence
  Description of Artificial Sequence: Synthetic polypeptide
EVQLVESGGGLVQPGGSLTLSCVASGSIFTTNSMGWHRQGPGKQRELVALIGSAGSTKYADSVKGRFTISRDNAKNSVYLQMNSLRAEDTAVYYCFYYDSRSYWGQGTLVTVSS

SEQ ID NO: 85 - protein, 118 aa, Artificial Sequence
  Description of Artificial Sequence: Synthetic polypeptide
EVQLVESGGGLVQPGGSLTLSCAASGITSSVYSMGWYRQAPGKQRELVAGSSSDGSTHYVDSVRGRFTISRDNAKNSVYLQMNSLRAEDTAVYYCYANRGFAGAPSYWGQGTLVTVSS

SEQ ID NO: 86 - protein, 115 aa, Artificial Sequence
  Description of Artificial Sequence: Synthetic polypeptide
EVQLVESGGGLVQPGGSLTLSCAASSSIFSISSMSWYRQAPGKQRELVAAITSFGSTNYADSVKGRFTISRDNAKNSMYLQMNSLRAEDTAVYYCNARTMGRDYWGQGTLVTVSS

SEQ ID NO: 87 - protein, 119 aa, Artificial Sequence
  Description of Artificial Sequence: Synthetic polypeptide
EVQLVESGGGLVQPGGSLTLSCVASGFTSSINAMGWYRRAPGKQRELVAGISSDGSFVYADSVKGRFTISRDNAKNSVYLQMNSLRAEDTAVYYCYYFRHVSGSSMRYWGQGTLVTVSS

SEQ ID NO: 88 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRTVSGSSSRYWGQGTLVTVSS

SEQ ID NO: 89 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYEDSVKGRFTISRDNAKNSVYLQMNSLRAEDTAVYYCYYFRTVSGSSMRYWGQGTLVTVSS

SEQ ID NO: 90 - protein, 119 aa, Artificial Sequence
  Description of Artificial Sequence: Synthetic polypeptide
EVQLVESGGGLVQPGGSLTLSCVASGSPSSINAMGWYRRAPGKQRELSAGISSDGSKVYADSVKGRFTISRDNAKNSVYLQMNSLRAEDTAVYYCYYFRTVRGSSMSYWGQGTLVTVSS

SEQ ID NO: 91 - protein, 119 aa, Artificial Sequence
  Description of Artificial Sequence: Synthetic polypeptide
EVQLVESGGGLVQPGGSLTLSCVASGSTSSINAMGWYRRAPGKQRELAAGISSDGSSVYADSVKGRFTISRDNAKNSVYLQMNSLRAEDTAVYYCYYFRTVSGSSKRYWGQGTLVTVSS

SEQ ID NO: 92 - protein, 119 aa, Artificial Sequence
  Description of Artificial Sequence: Synthetic polypeptide
EVQLVESGGGLVQPGGSLTLSCVASGSISSINAMGWYRRAPGKQRELVAGISSDGSKVYADSVKGRFTISRDNAKNSVYLQMNSLRAEDTAVYYCYYFRMVSGSSMRYWGQGTLVTVSS

SEQ ID NO: 93 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKLYADSVKGRFTISRDNAKNSVYLQMNSLRAEDTAVYYCYYFRTVQGSSMRYWGQGTLVTVSS

SEQ ID NO: 94 - protein, 119 aa, Artificial Sequence
  Description of Artificial Sequence: Synthetic polypeptide
EVQLVESGGGLVQPGGSLTLSCVASGSTSSINAYGWYRRAPGKQRELVAGISSDGSKVYADSVKGRFTISRDNAKNSVYLQMNSLRAEDTAVYYCYYFRTVYGSSMRYWGQGTLVTVSS

SEQ ID NO: 95 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYIDSVKGRFTISRDNAKNSVYLQMNSLRAEDTAVYYCYYFRTVSGSSYRYWGQGTLVTVSS

SEQ ID NO: 96 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYSDSVKGRFTISRDNAKNSVYLQMNSLRAEDTAVYYCYYFRTVLGSSMRYWGQGTLVTVSS

SEQ ID NO: 97 - protein, 119 aa, Artificial Sequence
  Description of Artificial Sequence: Synthetic polypeptide
EVQLVESGGGLVQPGGSLTLSCVASGSTSIINAMGWYRRAPGKQRELAAGISSDGSKVIADSVKGRFTISRDNAKNSVYLQMNSLRAEDTAVYYCYYFRRVSGSSMRYWGQGTLVTVSS

SEQ ID NO: 98 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKIYADSVKGRFTISRDNAKNSVYLQMNSLRAEDTAVYYCYYFRTVSGSSMRYWGQGTLVTVSS

SEQ ID NO: 99 - protein, 119 aa, Artificial Sequence
  Description of Artificial Sequence: Synthetic polypeptide
EVQLVESGGGLVQPGGSLTLSCVASGKTSSINAMAWYRRAPGKQRELVAGISSDGSKVYTDSVKGRFTISRDNAKNSVYLQMNSLRAEDTAVYYCYYFRTVSGSSARYWGQGTLVTVSS

SEQ ID NO: 100 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSLVYADSVKGRFTISRDNAKNSVYLQMNSLRAEDTAVYYCYYFRIVRGSSMRYWGQGTLVTVSS

SEQ ID NO: 101 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYYRTVSGSSMRYWGQGTLVTVSS

SEQ ID NO: 102 - protein, 119 aa, Artificial Sequence
  Description of Artificial Sequence: Synthetic polypeptide
EVQLVESGGGLVQPGGSLTLSCVASGSGSSINAMGWYRRAPGKQRELVAGISSDGSKVYSDSVKGRFTISRDNAKNSVYLQMNSLRAEDTAVYYCYYFRHVSGSSMRYWGQGTLVTVSS

SEQ ID NO: 103 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYVDSVKGRFTISRDNAKNSVYLQMNSLRAEDTAVYYCYYFRFVSGSSMRYWGQGTLVTVSS

SEQ ID NO: 104 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYVDSVKGRFTISRDNAKNSVYLQMNSLRAEDTAVYYCYYFRTVSGSSMRYWGQGTLVTVSS

SEQ ID NO: 105 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYADSVKGRFTISRDNAKNSVYLQMNSLRAEDTAVYYCYYFRTKSGSSMRYWGQGTLVTVSS

SEQ ID NO: 106 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYADSVKGRFTISRDNAKNSVYLQMNSLRAEDTAVYYCYYFRTVYGSSMRYWGQGTLVTVSS

SEQ ID NO: 107 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYRDSVKGRFTISRDNAKNSVYLQMNSLRAEDTAVYYCYYFRTVSGSSMGYWGQGTLVTVSS

SEQ ID NO: 108 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYSDSVKGRFTISRDNAKNSVYLQMNSLRAEDTAVYYCYYFRTVSGSSMRSWGQGTLVTVSS

SEQ ID NO: 109 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDNSKVYADSVKGRFTISRDNAKNSVYLQMNSLRAEDTAVYYCYYFRTVGGSSMRYWGQGTLVTVSS

SEQ ID NO: 110 - protein, 119 aa, Artificial Sequence
  Description of Artificial Sequence: Synthetic polypeptide
EVQLVESGGGLVQPGGSLTLSCVASGNTSSINAMAWYRRAPGKQRELVAGISSDGSKVYADSVKGRFTISRDNAKNSVYLQMNSLRAEDTAVYYCYYFRTVSGSSMRYWGQGTLVTVSS

SEQ ID NO: 111 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRTVSGSHMRYWGQGTLVTVSS

SEQ ID NO: 112 - protein, 119 aa, Artificial Sequence
  Description of Artificial Sequence: Synthetic polypeptide
EVQLVESGGGLVQPGGSLTLSCVASGSTSIINAMGWYRRAPGKQRELVAGISSDGSKVYEDSVKGRFTISRDNAKNSVYLQMNSLRAEDTAVYYCYYFRAVSGSSMRYWGQGTLVTVSS

SEQ ID NO: 113 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRTVSGSSMRYWGQGTLVTVSS

SEQ ID NO: 114 - protein, 119 aa, Artificial Sequence
  Description of Artificial Sequence: Synthetic polypeptide
EVQLVESGGGLVQPGGSLTLSCVASGSTSRINAMGWYRRAPGKQRELPAGISSDGSKVYAVSVKGRFTISRDNAKNSVYLQMNSLRAEDTAVYYCYYFRTVSGSPMRYWGQGTLVTVSS

SEQ ID NO: 115 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGVSSDGSKVYADSVKGRFTISRDNAKNSVYLQMNSLRAEDTAVYYCYYFRTVSGSSMSYWGQGTLVTVSS

SEQ ID NO: 116 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYEDSVKGRFTISRDNAKNSVYLQMNSLRAEDTAVYYCYYFRTVSGSSMRYWGQGTLVTVSS

SEQ ID NO: 117 - protein, 119 aa, Artificial Sequence
  Description of Artificial Sequence: Synthetic polypeptide
EVQLVESGGGLVQPGGSLTLSCVASGITSSINAMGWYRRAPGKQRELVAGISSDGSKVYAGSVKGRFTISRDNAKNSVYLQMNSLRAEDTAVYYCYYFRTVRGSSMRYWGQGTLVTVSS

SEQ ID NO: 118 - protein, 119 aa, Artificial Sequence
  Description of Artificial Sequence: Synthetic polypeptide
EVQLVESGGGLVQPGGSLTLSCVASGSTSDINAMGWYRRAPGKQRELVAGISSDKSKVYADSVKGRFTISRDNAKNSVYLQMNSLRAEDTAVYYCYYFRTVRGSSMRYWGQGTLVTVSS

SEQ ID NO: 119 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSNGSKVYADSVKGRFTISRDNAKNSVYLQMNSLRAEDTAVYYCYYFRQVSGSSMRYWGQGTLVTVSS

SEQ ID NO: 120 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVLADSVKGRFTISRDNAKNSVYLQMNSLRAEDTAVYYCYYFRIVSGSSMGYWGQGTLVTVSS

SEQ ID NO: 121 - protein, 119 aa, Artificial Sequence
  Description of Artificial Sequence: Synthetic polypeptide
EVQLVESGGGLVQPGGSLTLSCVASGSTSSKNAMGWYRRAPGKQRELVAGISSDGSKVYADSVKGRFTISRDNAKNSVYLQMNSLRAEDTAVYYCYYFRTVSGASMRYWGQGTLVTVSS

SEQ ID NO: 122 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDNSKVYADSVKGRFTISRDNAKNSVYLQMNSLRAEDTAVYYCYYFRTVHGSSMRYWGQGTLVTVSS

SEQ ID NO: 123 - protein, 119 aa, Artificial Sequence
  Description of Artificial Sequence: Synthetic polypeptide
EVQLVESGGGLVQPGGSLTLSCVASGLTSSINAMGWYRRAPGKQRELVAGISSDGSKVYADSVKGRFTISRDNAKNSVYLQMNSLRAEDTAVYYCYYFRMVSGSSMRYWGQGTLVTVSS

SEQ ID NO: 124 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYTDSVKGRFTISRDNAKNSVYLQMNSLRAEDTAVYYCYYFRTISGSSMRYWGQGTLVTVSS

SEQ ID NO: 125 - protein, 119 aa, Artificial Sequence
  Description of Artificial Sequence: Synthetic polypeptide
EVQLVESGGGLVQPGGSLTLSCVASGSTSSNNAMAWYRRAPGKQRELVAGISSDGSKVYTDSVKGRFTISRDNAKNSVYLQMNSLRAEDTAVYYCYYFRTRSGSSMRYWGQGTLVTVSS

SEQ ID NO: 126 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDNSKVYADSVKGRFTISRDNAKNSVYLQMNSLRAEDTAVYYCYYFRTVSGHSMRYWGQGTLVTVSS

SEQ ID NO: 127 - protein, 119 aa, Artificial Sequence
  Description of Artificial Sequence: Synthetic polypeptide
EVQLVESGGGLVQPGGSLTLSCVASGSTSHINAMGWYRRAPGKQRELVAGISSDGSRVYADSVKGRFTISRDNAKNSVYLQMNSLRAEDTAVYYCYYFRTVSGGSMRYWGQGTLVTVSS

SEQ ID NO: 128 - protein, 119 aa, Artificial Sequence
  Description of Artificial Sequence: Synthetic polypeptide
EVQLVESGGGLVQPGGSLTLSCVASGQTSSINAMGWYRRAPGKQRELVAGISSDGSQVYADSVKGRFTISRDNAKNSVYLQMNSLRAEDTAVYYCYYFRTKSGSSMRYWGQGTLVTVSS

SEQ ID NO: 129 - protein, 119 aa, Artificial Sequence
  Description of Artificial Sequence: Synthetic polypeptide
EVQLVESGGGLVQPGGSLTLSCVASGSTSRINGMGWYRRAPGKQRELPAGISSDGSKAYADSVKGRFTISRDNAKNSVYLQMNSLRAEDTAVYYCYYFRTASGTSMRYWGQGTLVTVSS

SEQ ID NO: 130 - protein, 119 aa, Artificial Sequence
  Description of Artificial Sequence: Synthetic polypeptide
EVQLVESGGGLVQPGGSLTLSCVASGSTSVINAMAWYRRAPGKQRELAAGISSDGSKVYAKSAKGRFTISRDNAKNSVYLQMNSLRAEDTAVYYCYYFNTVSGSSMRYWGQGTLVTVSS

SEQ ID NO: 131 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYNDSVKGRFTISRDNAKNSVYLQMNSLRAEDTAVYYCYYFRTVRGSSQRYWGQGTLVTVSS

SEQ ID NO: 132 - protein, 119 aa, Artificial Sequence
  Description of Artificial Sequence: Synthetic polypeptide
EVQLVESGGGLVQPGGSLTLSCVASGKTSSINAMGWYRRAPGKQRELVAGISSDGSKVIADSVKGRFTISRDNAKNSVYLQMNSLRAEDTAVYYCYYFRTVLGSSMRYWGQGTLVTVSS

SEQ ID NO: 133 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYTDSVKGRFTISRDNAKNSVYLQMNSLRAEDTAVYYCYYFRTRSGSSMRYWGQGTLVTVSS

SEQ ID NO: 134 - protein, 119 aa, Artificial Sequence
  Description of Artificial Sequence: Synthetic polypeptide
EVQLVESGGGLVQPGGSLTLSCVASGSVSSINAMGWYRRAPGKQRELVAGISSDGSKVYIDSVKGRFTISRDNAKNSVYLQMNSLRAEDTAVYYCYYFRTVSGLSMRYWGQGTLVTVSS

SEQ ID NO: 135 - protein, 119 aa, Artificial Sequence
  Description of Artificial Sequence: Synthetic polypeptide
EVQLVESGGGLVQPGGSLTLSCVASGNTSSINAMGWYRRAPGKQRELVAGISSDGSKVYYDSVKGRFTISRDNAKNSVYLQMNSLRAEDTAVYYCYYFRTVRGSSQRYWGQGTLVTVSS

SEQ ID NO: 136 - protein, 119 aa, Artificial Sequence
  Description of Artificial Sequence: Synthetic polypeptide
EVQLVESGGGLVQPGGSLTLSCVASGSTSSTNAMGWYRRAPGKQRELVAGISSDGSKVYVDSVKGRFTISRDNAKNSVYLQMNSLRAEDTAVYYCYYFRTVSGSSMVYWGQGTLVTVSS

SEQ ID NO: 137 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYGDSVKGRFTISRDNAKNSVYLQMNSLRAEDTAVYYCYYFRTVSRSSMRYWGQGTLVTVSS

SEQ ID NO: 138 - protein, 119 aa, Artificial Sequence
  Description of Artificial Sequence: Synthetic polypeptide
EVQLVESGGGLVQPGGSLTLSCVASGSTSSINAMAWYRRAPGKQRELAAGISSDQSKVYADSAKGRFTISRDNAKNSVYLQMNSLRAEDTAVYYCYYFRTVSGSSMSYWGQGTLVTVSS

SEQ ID NO: 139 - protein, 119 aa, Artificial Sequence
  Description of Artificial Sequence: Synthetic polypeptide
EVQLVESGGGLVQPGGSLTLSCVASGGTSSINAMGWYRRAPGKQRELVAGISSDGSKVYSDSVKGRFTISRDNAKNSVYLQMNSLRAEDTAVYYCYYFRTVSGSSARYWGQGTLVTVSS

SEQ ID NO: 140 - protein, 119 aa, Artificial Sequence
  Description of Artificial Sequence: Synthetic polypeptide
EVQLVESGGGLVQPGGSLTLSCVASGSTRSINAMGWYRRAPGKQRELVAGISSDGSKVYADSVKGRFTISRDNAKNSVYLQMNSLRAEDTAVYYCYYFHTVSGSSMRYWGQGTLVTVSS

SEQ ID NO: 141 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVIADSVKGRFTISRDNAKNSVYLQMNSLRAEDTAVYYCYYFRTVLGSSMRYWGQGTLVTVSS

SEQ ID NO: 142 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVDADSVKGRFTISRDNAKNSVYLQMNSLRAEDTAVYYCYYFRTVSGSSMRYWGQGTLVTVSS

SEQ ID NO: 143 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYKDSVKGRFTISRDNAKNSVYLQMNSLRAEDTAVYYCYYFRNVSGSSMRYWGQGTLVTVSS

SEQ ID NO: 144 - protein, 119 aa, Artificial Sequence
  Description of Artificial Sequence: Synthetic polypeptide
EVQLVESGGGLVQPGGSLTLSCVASGNTSSINAMGWYRRAPGKQRELVAGISSNGSKVYADSVKGRFTISRDNAKNSVYLQMNSLRAEDTAVYYCYYFRTVTGSSMRYWGQGTLVTVSS

SEQ ID NO: 145 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYKDSVKGRFTISRDNAKNSVYLQMNSLRAEDTAVYYCYYFRTVSGSSMRYWGQGTLVTVSS

SEQ ID NO: 146 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYADSVKGRFTISRDNAKNSVYLQMNSLRAEDTAVYYCYYFRTVKGSSMRYWGQGTLVTVSS

SEQ ID NO: 147 - protein, 119 aa, Artificial Sequence
  Description of Artificial Sequence: Synthetic polypeptide
EVQLVESGGGLVQPGGSLTLSCVASGLTSSINAMGWYRRAPGKQRELVAGISSDGSKVYQDSVKGRFTISRDNAKNSVYLQMNSLRAEDTAVYYCYYFRTNSGSSMRYWGQGTLVTVSS

SEQ ID NO: 148 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYAESVKGRFTISRDNAKNSVYLQMNSLRAEDTAVYYCYYFRTVSGASMRYWGQGTLVTVSS

SEQ ID NO: 149 - protein, 119 aa, Artificial Sequence
  Description of Artificial Sequence: Synthetic polypeptide
EVQLVESGGGLVQPGGSLTLSCVASGSTSSTNAMGWYRRAPGKQRELVAGISSDGSKVLADSVKGRFTISRDNAKNSVYLQMNSLRAEDTAVYYCYYFRTVNLSSMRYWGQGTLVTVSS

SEQ ID NO: 150 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKYYADSVKGRFTISRDNAKNSVYLQMNSLRAEDTAVYYCYYFRTVTGSSMRYWGQGTLVTVSS

SEQ ID NO: 151 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYAVSVKGRFTISRDNAKNSVYLQMNSLRAEDTAVYYCYYFRKVSGSSARYWGQGTLVTVSS

SEQ ID NO: 152 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVVADSVKGRFTISRDNAKNSVYLQMNSLRAEDTAVYYCYYFRTYSGSSMRYWGQGTLVTVSS

SEQ ID NO: 153 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYADSVKGRFTISRDNAKNSVYLQMNSLRAEDTAVYYCYYFRTVSKSSMRYWGQGTLVTVSS

SEQ ID NO: 154 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFKTVSGSSMRYWGQGTLVTVSS

SEQ ID NO: 155 - protein, 119 aa, Artificial Sequence
  Description of Artificial Sequence: Synthetic polypeptide
EVQLVESGGGLVQPGGSLTLSCVASGSTSSINAMAWYRRAPGKQRELAAGISSDNSKVYADSVKGRFTISRDNAKNSVYLQMNSLRAEDTAVYYCYYFRTRSGSSMRYWGQGTLVTVSS

SEQ ID NO: 156 - protein, 119 aa, Artificial Sequence
  Description of Artificial Sequence: Synthetic polypeptide
EVQLVESGGGLVQPGGSLTLSCVASGSKSSINAMGWYRRAPGKQRELAAGISSDGSKVYAQSVKGRFTISRDNAKNSVYLQMNSLRAEDTAVYYCYYFRTSSGSSMRYWGQGTLVTVSS

SEQ ID NO: 157 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYVDSVKGRFTISRDNAKNSVYLQMNSLRAEDTAVYYCYYFRFLSGSSMRYWGQGTLVTVSS

SEQ ID NO: 158 - protein, 119 aa, Artificial Sequence
  Description of Artificial Sequence: Synthetic polypeptide
EVQLVESGGGLVQPGGSLTLSCVASGSTSSINAFGWYRRAPGKQRELVAGISSDGSKVYSDSVKGRFTISRDNAKNSVYLQMNSLRAEDTAVYYCYYFRTVSGSSMRYWGQGTLVTVSS

SEQ ID NO: 159 - protein, 119 aa, Artificial Sequence
  Description of Artificial Sequence: Synthetic polypeptide
EVQLVESGGGLVQPGGSLTLSCVASGSTFSINAMGWYRRAPGKQRELVAGISSDGSKVLADSVKGRFTISRDNAKNSVYLQMNSLRAEDTAVYYCYYFRLVSGSSMRYWGQGTLVTVSS

SEQ ID NO: 160 - protein, 119 aa, Artificial Sequence
  Description of Artificial Sequence: Synthetic polypeptide
EVQLVESGGGLVQPGGSLTLSCVASGSTRSINAMGWYRRAPGKQRELVAGISSDGSKVYNDSVKGRFTISRDNAKNSVYLQMNSLRAEDTAVYYCYYFRTVSGSSMRFWGQGTLVTVSS

SEQ ID NO: 161 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYNDSVKGRFTISRDNAKNSVYLQMNSLRAEDTAVYYCYYFRTQSGSSMRYWGQGTLVTVSS

SEQ ID NO: 162 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYVDSVKGRFTISRDNAKNSVYLQMNSLRAEDTAVYYCYYFRTVSGSSMPYWGQGTLVTVSS

SEQ ID NO: 163 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVVADSVKGRFTISRDNAKNSVYLQMNSLRAEDTAVYYCYYFRTLSGSSMRYWGQGTLVTVSS

SEQ ID NO: 164 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYGDSVKGRFTISRDNAKNSVYLQMNSLRAEDTAVYYCYYFRTVSGSAMRYWGQGTLVTVSS

SEQ ID NO: 165 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYTDSVKGRFTISRDNAKNSVYLQMNSLRAEDTAVYYCYYFRTTSGSSMRYWGQGTLVTVSS

SEQ ID NO: 166 - protein, 119 aa, Artificial Sequence
  Description of Artificial Sequence: Synthetic polypeptide
EVQLVESGGGLVQPGGSLTLSCVASGRTSSINAMGWYRRAPGKQRELVAGISSDGSKVYNDSVKGRFTISRDNAKNSVYLQMNSLRAEDTAVYYCYYFRTVSGTSMRYWGQGTLVTVSS

SEQ ID NO: 167 - protein, 119 aa, Artificial Sequence
  Description of Artificial Sequence: Synthetic polypeptide
EVQLVESGGGLVQPGGSLTLSCVASGSTSSRNAMGWYRRAPGKQRELVAGISSDGSKVTADSVKGRFTISRDNAKNSVYLQMNSLRAEDTAVYYCYYFRTRSGSSMRYWGQGTLVTVSS

SEQ ID NO: 168 - protein, 119 aa, Artificial Sequence
  Description of Artificial Sequence: Synthetic polypeptide
EVQLVESGGGLVQPGGSLTLSCVASGSTKSINAMGWYRRAPGKQRELVAGISSDGSKVYRDSVKGRFTISRDNAKNSVYLQMNSLRAEDTAVYYCYYFRTSSGSSMRYWGQGTLVTVSS

SEQ ID NO: 169 - protein, 119 aa, Artificial Sequence
  Description of Artificial Sequence: Synthetic polypeptide
EVQLVESGGGLVQPGGSLTLSCVASGSTSSRNAMGWYRRAPGKQRELVAGISSNGSKVYSDSVKGRFTISRDNAKNSVYLQMNSLRAEDTAVYYCYYFRTVSGSSMSYWGQGTLVTVSS

SEQ ID NO: 170 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYSDSVKGRFTISRDNAKNSVYLQMNSLRAEDTAVYYCYYFRPVSGSSMRYWGQGTLVTVSS

SEQ ID NO: 171 - protein, 119 aa, Artificial Sequence
  Description of Artificial Sequence: Synthetic polypeptide
EVQLVESGGGLVQPGGSLTLSCVASGSTSLINAMGWYRRAPGKQRELVAGISSDGSKVYADSVKGRFTISRDNAKNSVYLQMNSLRAEDTAVYYCYYFRHVSGSSMRYWGQGTLVTVSS

SEQ ID NO: 172 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRTKSGSSMRYWGQGTLVTVSS

SEQ ID NO: 173 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSLVYADSVKGRFTISRDNAKNSVYLQMNSLRAEDTAVYYCYYFTTVSGSSMRYWGQGTLVTVSS

SEQ ID NO: 174 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGTKVYADSVKGRFTISRDNAKNSVYLQMNSLRAEDTAVYYCYYFHTVSGSSMRYWGQGTLVTVSS

SEQ ID NO: 175 - protein, 119 aa, Artificial Sequence
  Description of Artificial Sequence: Synthetic polypeptide
EVQLVESGGGLVQPGGSLTLSCVASGSTSSINAFGWYRRAPGKQRELVAGISSDGSKVYADSVKGRFTISRDNAKNSVYLQMNSLRAEDTAVYYCYYFRTVRGSSMRYWGQGTLVTVSS

SEQ ID NO: 176 - protein, 119 aa, Artificial Sequence
  Description of Artificial Sequence: Synthetic polypeptide
EVQLVESGGGLVQPGGSLTLSCVASGSTSSRNAMGWYRRAPGKQRELVAGISSDGSKLYLDSVKGRFTISRDNAKNSVYLQMNSLRAEDTAVYYCYYFRTVLGSSMRYWGQGTLVTVSS

SEQ ID NO: 177 - protein, 119 aa, Artificial Sequence
  Description of Artificial Sequence: Synthetic polypeptide
EVQLVESGGGLVQPGGSLTLSCVASGNTSSINAMGWYRRAPGKQRELVAGISSDGSRVYADSVKGRFTISRDNAKNSVYLQMNSLRAEDTAVYYCYYFRTVSGSSMRSWGQGTLVTVSS

SEQ ID NO: 178 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYNDSVKGRFTISRDNAKNSVYLQMNSLRAEDTAVYYCYYFRTVRGSSMRYWGQGTLVTVSS

SEQ ID NO: 179 - protein, 119 aa, Artificial Sequence
  Description of Artificial Sequence: Synthetic polypeptide
EVQLVESGGGLVQPGGSLTLSCVASGSTASINAMGWYRRAPGKQRELVAGISSDGSKVYADSVKGRFTISRDNAKNSVYLQMNSLRAEDTAVYYCYYFRYVSGSSMRYWGQGTLVTVSS

SEQ ID NO: 180 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSKVYVDSVKGRFTISRDNAKNSVYLQMNSLRAEDTAVYYCYYFRTVYGSSMRYWGQGTLVTVSS

SEQ ID NO: 181 - protein, 119 aa, Artificial Sequence
  Description of Artificial Sequence: Synthetic polypeptide
EVQLVESGGGLVQPGGSLTLSCVASGSTSSRNAMGWYRRAPGKQRELVAGISSDGSKLYADSVKGRFTISRDNAKNSVYLQMNSLRAEDTAVYYCYYFRTVLGSSMRYWGQGTLVTVSS

SEQ ID NO: 182 - protein, 119 aa, Artificial Sequence
  Description of Artificial Sequence: Synthetic polypeptide
EVQLVESGGGLVQPGGSLTLSCVASGSTNSINAMGWYRRAPGKQRELVAGISSDGSKVYKDSVKGRFTISRDNAKNSVYLQMNSLRAEDTAVYYCYYYRTVSGSSMRYWGQGTLVTVSS

SEQ ID NO: 183 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRSVSGSSMRYWGQGTLVTVSS

SEQ ID NO: 184 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYQDSVKGRFTISRDNAKNSVYLQMNSLRAEDTAVYYCYYFRRVSGSSMRYWGQGTLVTVSS

SEQ ID NO: 185 - protein, 119 aa, Artificial Sequence
  Description of Artificial Sequence: Synthetic polypeptide
EVQLVESGGGLVQPGGSLTLSCVPSGSTSNINAMGWYRRAPGKQRELPAGISSDGTKIYADSAKVPFTITRDNAKNSVYLQMNSLRAEDTAVYYCYYFRTVSGTSMRYWGQGTLVTVSS

SEQ ID NO: 186 - protein, 119 aa, Artificial Sequence
  Description of Artificial Sequence: Synthetic polypeptide
EVQLVESGGGLVQPGGSLTLSCVASGSTSKINAMGWYRRAPGKQRELVAGISSDRSKVYADSVKGRFTISRDNAKNSVYLQMNSLRAEDTAVYYCYYFRTVAGSSMRYWGQGTLVTVSS

SEQ ID NO: 187 - protein, 119 aa, Artificial Sequence
  Description of Artificial Sequence: Synthetic polypeptide
EVQLVESGGGLVQPGGSLTLSCVASGSTSSINALGWYRRAPGKQRELVAGISSDGSLVYADSVKGRFTISRDNAKNSVYLQMNSLRAEDTAVYYCYYFRIVSGSSMRYWGQGTLVTVSS

SEQ ID NO: 188 - protein, 119 aa, Artificial Sequence
  Description of Artificial Sequence: Synthetic polypeptide
EVQLVESGGGLVQPGGSLTLSCVASGKTSSINAMGWYRRAPGKQRELVAGISSDGSKVYADSVKGRFTISRDNAKNSVYLQMNSLRAEDTAVYYCYYFRTVSGVSMRYWGQGTLVTVSS

SEQ ID NO: 189 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSKVYRDSVKGRFTISRDNAKNSVYLQMNSLRAEDTAVYYCYYFRTVQGSSMRYWGQGTLVTVSS

SEQ ID NO: 190 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYADSVKGRFTISRDNAKNSVYLQMNSLRAEDTAVYYCYYFRTASGSSMRYWGQGTLVTVSS

SEQ ID NO: 191 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYSDSVKGRFTISRDNAKNSVYLQMNSLRAEDTAVYYCYYFRTVSGSSSRYWGQGTLVTVSS

SEQ ID NO: 192 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGTKVYRDSVKGRFTISRDNAKNSVYLQMNSLRAEDTAVYYCYYFRTVQGSSMRYWGQGTLVTVSS

SEQ ID NO: 193 - protein, 119 aa, Artificial Sequence
  Description of Artificial Sequence: Synthetic polypeptide
EVQLVESGGGLVQPGGSLTLSCVASGTTSSINAMGWYRRAPGKQRELAAGISSDGSKVYNDSVKGRFTISRDNAKNSVYLQMNSLRAEDTAVYYCYYFRTVRGSSMRYWGQGTLVTVSS

SEQ ID NO: 194 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYADSVKGRFTISRDNAKNSVYLQMNSLRAEDTAVYYCYYFRTKSGSSMRYWGQGTLVTVSS

SEQ ID NO: 195 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYADSVKGRFTISRDNAKNSVYLQMNSLRAEDTAVYYCYYFRTVWGSSMRYWGQGTLVTVSS

SEQ ID NO: 196 - protein, 119 aa, Artificial Sequence
  Description of Artificial Sequence: Synthetic polypeptide
EVQLVESGGGLVQPGGSLTLSCVASGKTSSINAMGWYRRAPGKQRELVAGISSDGSKVYTDSVKGRFTISRDNAKNSVYLQMNSLRAEDTAVYYCYYFRTRSGSSMRYWGQGTLVTVSS

SEQ ID NO: 197 - protein, 119 aa, Artificial Sequence
  Description of Artificial Sequence: Synthetic polypeptide
EVQLVESGGGLVQPGGSLTLSCVASGSTSSINAMGWYRRAPFKQGELPAGISPDGTKAYADSAKVRFTISRDNAKNSVYLQMNSLRAEDTAVYYCYYFHTVCGTSMGYWGQGTLVTVSS

SEQ ID NO: 198 - protein, 119 aa, Artificial Sequence
  Description of Artificial Sequence: Synthetic polypeptide
EVQLVESGGGLVQPGGSLTLSCVASGSTSAINAMGWYRRAPGKQRELVAGISSDGSKVYVDSVKGRFTISRDNAKNSVYLQMNSLRAEDTAVYYCYYFRTVSGSSQRYWGQGTLVTVSS

SEQ ID NO: 199 - protein, 119 aa, Artificial Sequence
  Description of Artificial Sequence: Synthetic polypeptide
EVQLVESGGGLVQPGGSLTLSCVASGSPSSINAYGWYRRAPGKQRELVAGISSDGSKVYSDSVKGRFTISRDNAKNSVYLQMNSLRAEDTAVYYCYYFRTVSGSSMSYWGQGTLVTVSS

SEQ ID NO: 200 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYASSVKGRFTISRDNAKNSVYLQMNSLRAEDTAVYYCYYFRTVRGSSMRYWGQGTLVTVSS

SEQ ID NO: 201 - protein, 119 aa, Artificial Sequence
  Description of Artificial Sequence: Synthetic polypeptide
EVQLVESGGGLVQPGGSLTLSCVASGSRSSINAMGWYRRAPGKQRELVAGISADGSKVYADSVKGRFTISRDNAKNSVYLQMNSLRAEDTAVYYCYYFRTQSGSSMRYWGQGTLVTVSS

SEQ ID NO: 202 - protein, 119 aa, Artificial Sequence
  Description of Artificial Sequence: Synthetic polypeptide
EVQLVESGGGLVQPGGSLTLSCVASGSVSSINAMGWYRRAPGKQRELVAGISSDGSKVYASSAKGRFTISRDNAKNSVYLQMNSLRAEDTAVYYCYYFRTLSGSSMRYWGQGTLVTVSS

SEQ ID NO: 203 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFHTVSGSSMRYWGQGTLVTVSS

SEQ ID NO: 204 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSSVYADSVKGRFTISRDNAKNSVYLQMNSLRAEDTAVYYCYYFRRVSGSSMRYWGQGTLVTVSS

SEQ ID NO: 205 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYSDSVKGRFTISRDNAKNSVYLQMNSLRAEDTAVYYCYYFRLVSGSSMRYWGQGTLVTVSS

SEQ ID NO: 206 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSKVYAGSVKGRFTISRDNAKNSVYLQMNSLRAEDTAVYYCYYFRTVSGSYMRYWGQGTLVTVSS

SEQ ID NO: 207 - protein, 119 aa, Artificial Sequence
  Description of Artificial Sequence: Synthetic polypeptide
EVQLVESGGGLVQPGGSLTLSCVASGSTSSINAMAWYRRAPGKQRELAAGISSDNSKVYADSVKGRFTISRDNAKNSVYLQMNSLRAEDTAVYYCYYFRTVGGSSMRYWGQGTLVTVSS

SEQ ID NO: 208 - protein, 119 aa, Artificial Sequence
  Description of Artificial Sequence: Synthetic polypeptide
EVQLVESGGGLVQPGGSLTLSCVASGSTSSINAYGWYRRAPGKQRELVAGISSDGSAVYADSVKGRFTISRDNAKNSVYLQMNSLRAEDTAVYYCYYFRTHSGSSMRYWGQGTLVTVSS

SEQ ID NO: 209 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSSVYADSVKGRFTISRDNAKNSVYLQMNSLRAEDTAVYYCYYFRTVSTSSMRYWGQGTLVTVSS

SEQ ID NO: 210 - protein, 119 aa, Artificial Sequence
  Description of Artificial Sequence: Synthetic polypeptide
EVQLVESGGGLVQPGGSLTLSCVASGSKSSINAMGWYRRAPGKQRELPAGISSNGTKVYADSAKVRFTISRDNAKNSVYLQMNSLRAEDTAVYYCYYFRTVLGTSMRYWGQGTLVTVSS

SEQ ID NO: 211 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKLYADSVKGRFTISRDNAKNSVYLQMNSLRAEDTAVYYCYYFRTVSGSSMRYWGQGTLVTVSS

SEQ ID NO: 212 - protein, 119 aa, Artificial Sequence
  Description of Artificial Sequence: Synthetic polypeptide
EVQLVESGGGLVQPGGSLTLSCVASGSVSSINAMGWYRRAPGKQRELVAGISSDGSKVYKDSVKGRFTISRDNAKNSVYLQMNSLRAEDTAVYYCYYFRTVSGSSMGYWGQGTLVTVSS

SEQ ID NO: 213 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSLVYADSVKGRFTISRDNAKNSVYLQMNSLRAEDTAVYYCYYFRTVSGSSMRAWGQGTLVTVSS

SEQ ID NO: 214 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSLVYADSVKGRFTISRDNAKNSVYLQMNSLRAEDTAVYYCYYFRILSGSSMRYWGQGTLVTVSS

SEQ ID NO: 215 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRTVQGSSMRYWGQGTLVTVSS

SEQ ID NO: 216 - protein, 119 aa, Artificial Sequence
  Description of Artificial Sequence: Synthetic polypeptide
EVQLVESGGGLVQPGGSLTLSCVASGSTSYINAMGWYRRAPGKQRELVAGISSDGSKVYADSVKGRFTISRDNAKNSVYLQMNSLRAEDTAVYYCYYFRTVSGQSMGYWGQGTLVTVSS

SEQ ID NO: 217 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGVSSDGSKVYADSVKGRFTISRDNAKNSVYLQMNSLRAEDTAVYYCYYFRTVSGSSARYWGQGTLVTVSS

SEQ ID NO: 218 - protein, 119 aa, Artificial Sequence
  Description of Artificial Sequence: Synthetic polypeptide
EVQLVESGGGLVQPGGSLTLSCVASGSTSSINAMGWYRRAPGKQRELPAGISRDGSKVYADSVKGRFTISRDNAKNSVYLQMNSLRAEDTAVYYCYYFRYVSGSSMRYWGQGTLVTVSS

SEQ ID NO: 219 - protein, 119 aa, Artificial Sequence
  Description of Artificial Sequence: Synthetic polypeptide
EVQLVESGGGLVQPGGSLTLSCVASGSTSSINAMGWYRRAPGKQRELAAGISSDGSKLYADSVKGRFTISRDNAKNSVYLQMNSLRAEDTAVYYCYYFRTVSGSSMRYWGQGTLVTVSS

SEQ ID NO: 220 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYADSVKGRFTISRDNAKNSVYLQMNSLRAEDTAVYYCYYFRRVSGSSMRYWGQGTLVTVSS

SEQ ID NO: 221 - protein, 119 aa, Artificial Sequence
  Description of Artificial Sequence: Synthetic polypeptide
EVQLVESGGGLVQPGGSLTLSCVASGSTSSINAMAWYRRAPGKQRELAAGISSDGSKVYADSVKGRFTISRDNAKNSVYLQMNSLRAEDTAVYYCYYFHTVSGSSMRYWGQGTLVTVSS

SEQ ID NO: 222 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRQVSGSSMRYWGQGTLVTVSS

SEQ ID NO: 223 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDTSKVYADSVKGRFTISRDNAKNSVYLQMNSLRAEDTAVYYCYYFRTVSGSYMRYWGQGTLVTVSS

SEQ ID NO: 224 - protein, 119 aa, Artificial Sequence
  Description of Artificial Sequence: Synthetic polypeptide
EVQLVESGGGLVQPGGSLTLSCVASGSTSTINAMGWYRRAPGKQRELVAGISSDGSKVYADSVKGRFTISRDNAKNSVYLQMNSLRAEDTAVYYCYYFRTASGSSMRYWGQGTLVTVSS

SEQ ID NO: 225 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSTVYADSVKGRFTISRDNAKNSVYLQMNSLRAEDTAVYYCYYFRTVSGHSMRYWGQGTLVTVSS

SEQ ID NO: 226 - protein, 119 aa, Artificial Sequence
  Description of Artificial Sequence: Synthetic polypeptide
EVQLVESGGGLVQPGGSLTLSCVASGSTSSINAMGWYRRAPGKQRELAAGISKDGSKVYADSAKGRFTISRDNAKNSVYLQMNSLRAEDTAVYYCYYFRTVSGSSSRYWGQGTLVTVSS

SEQ ID NO: 227 - protein, 119 aa, Artificial Sequence
  Description of Artificial Sequence: Synthetic polypeptide
EVQLVESGGGLVQPGGSLTLSCVASGSPSSINAYGWYRRAPGKQRELVAGISSDGSKVYSDSVKGRFTISRDNAKNSVYLQMNSLRAEDTAVYYCYYFRTVSGSSYSYWGQGTLVTVSS

SEQ ID NO: 228 - protein, 119 aa, Artificial Sequence
  Description of Artificial Sequence: Synthetic polypeptide
EVQLVESGGGLVQPGGSLTLSCVASGSPSSINAYGWYRRAPGKQRELVAGISSDGSKVYSDSVKGRFTISRDNAKNSVYLQMNSLRAEDTAVYYCYYFRTVSGSSQSYWGQGTLVTVSS

SEQ ID NO: 229 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYIDSVKGRFTISRDNAKNSVYLQMNSLRAEDTAVYYCYAYRWTRRYTYWGQGTLVTVSS

SEQ ID NO: 230 - protein, 117 aa, Artificial Sequence
  Description of Artificial Sequence: Synthetic polypeptide
EVQLVESGGGLVQPGGSLTLSCAASGSSVSFLSLAWYRQAPGKKRELVAGISADGSTAYIDSVKGRFTISRDNAKNSVYLQMNSLRAEDTAVYYCYAYRWRTRYTYWGQGTLVTVSS

SEQ ID NO: 231 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISRDGSTDYIDSVKGRFTISRDNAKNSVYLQMNSLRAEDTAVYYCYAYRWTTRRTYWGQGTLVTVSS

SEQ ID NO: 232 - protein, 117 aa, Artificial Sequence
  Description of Artificial Sequence: Synthetic polypeptide
EVQLVESGGGLVQPGGSLTLSCAASGSQVSFLSMAWYRQAPGKKRELVAGISRDGSTDYIDSVKGRFTISRDNAKNSVYLQMNSLRAEDTAVYYCYAYRWTTRYIYWGQGTLVTVSS

SEQ ID NO: 233 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISEAGSTDYIDSVKGRFTISRDNAKNSVYLQMNSLRAEDTAVYYCYAYRWRTRYTYWGQGTLVTVSS

SEQ ID NO: 234 - protein, 117 aa, Artificial Sequence
  Description of Artificial Sequence: Synthetic polypeptide
EVQLVESGGGLVQPGGSLTLRCAASGSKVSFLSMAWYRQAPGKKRELVAGISADGSTDYVDSVKGRFTISRDNAKNSVYLQMNSLRAEDTAVYYCYAYRWTRRYTYWGQGTLVTVSS

SEQ ID NO: 235 - protein, 117 aa, Artificial Sequence
  Description of Artificial Sequence: Synthetic polypeptide
EVQLVESGGGLVQPGGSLTLSCAASGSSVGFLSMAWYRQAPGKKRELVAGISADGSTDYIRSVKGRFTISRDNAKNSVYLQMNSLRAEDTAVYYCYAYRWRTRYTYWGQGTLVTVSS

SEQ ID NO: 236 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSVDYIDSVKGRFTISRDNAKNSVYLQMNSLRAEDTAVYYCYAYRWTTRYIYWGQGTLVTVSS

SEQ ID NO: 237 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTLYIDSVKGRFTISRDNAKNSVYLQMNSLRAEDTAVYYCYAYRWTTRRTYWGQGTLVTVSS

SEQ ID NO: 238 - protein, 117 aa, Artificial Sequence
  Description of Artificial Sequence: Synthetic polypeptide
EVQLVESGGGLVQPGGSLTLSCAASGSSVSFLSLAWYRQAPGKKRELVAGISTDGSTDYIDSVKGRFTISRDNAKNSVYLQMNSLRAEDTAVYYCYAYRWRTRYTYWGQGTLVTVSS

SEQ ID NO: 239 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISGDGSTDYIDSVKGRFTISRDNAKNSVYLQMNSLRAEDTAVYYCYAYRWTTRYTYWGQGTLVTVSS

SEQ ID NO: 240 - protein, 117 aa, Artificial Sequence
  Description of Artificial Sequence: Synthetic polypeptide
EVQLVESGGGLVQPGGSLTLSCAASGSSVQFLSMAWYRQAPGKKRELVAGISADGSTDYINSVKGRFTISRDNAKNSVYLQMNSLRAEDTAVYYCYAYRWRTRYTYWGQGTLVTVSS

SEQ ID NO: 241 - protein, 117 aa, Artificial Sequence
  Description of Artificial Sequence: Synthetic polypeptide
EVQLVESGGGLVQPGGSLTLSCAASGSNVSFLSMAWYRQAPGKKRELVAGISARGSTDYIDSVKGRFTISRDNAKNSVYLQMNSLRAEDTAVYYCYAYHWTTRYTYWGQGTLVTVSS

SEQ ID NO: 242 - protein, 117 aa, Artificial Sequence
  Description of Artificial Sequence: Synthetic polypeptide
EVQLVESGGGLVQPGGSLTLSCVASGSSVKFLSMAWYRQAPGKKRELVAGISADGSTTYIDSVKGRFTISRDNAKNSVYLQMNSLRAEDTAVYYCYAYRWTTRRTYWGQGTLVTVSS

SEQ ID NO: 243 - protein, 117 aa, Artificial Sequence
  Description of Artificial Sequence: Synthetic polypeptide
EVQLVESGGGLVQPGGSLTLSCAASGKSVSFLSMAWYRQAPGKKRELVAGISKDGSTDYIDSVKGRFTISRDNAKNSVYLQMNSLRAEDTAVYYCYAYRWTTRYTYWGQGTLVTVSS

SEQ ID NO: 244 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTTYIDSVKGRFTISRDNAKNSVYLQMNSLRAEDTAVYYCYAYRWTTRYTYWGQGTLVTVSS

SEQ ID NO: 245 - protein, 117 aa, Artificial Sequence
  Description of Artificial Sequence: Synthetic polypeptide
EVQLVESGGGLVQPGGSLTLSCAASGSHVSFLSMAWYRQAPGKKRELVAGISANGSTDYIDSVKGRFTISRDNAKNSVYLQMNSLRAEDTAVYYCYAYRWTTRYAYWGQGTLVTVSS

SEQ ID NO: 246 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISRDGSTDYIDSVKGRFTISRDNAKNSVYLQMNSLRAEDTAVYYCYAYRWVTRYTYWGQGTLVTVSS

SEQ ID NO: 247 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSADYIDSVKGRFTISRDNAKNSVYLQMNSLRAEDTAVYYCYAYRWVTRYTYWGQGTLVTVSS

SEQ ID NO: 248 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISAHGSTDYIDSVKGRFTISRDNAKNSVYLQMNSLRAEDTAVYYCYAYRWSTRYTYWGQGTLVTVSS

SEQ ID NO: 249 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTIYIDSVKGRFTISRDNAKNSVYLQMNSLRAEDTAVYYCYAYRWRTRYTYWGQGTLVTVSS

SEQ ID NO: 250 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISRDGSTVYIDSVKGRFTISRDNAKNSVYLQMNSLRAEDTAVYYCYAYRWTTRGTYWGQGTLVTVSS

SEQ ID NO: 251 - protein, 117 aa, Artificial Sequence
  Description of Artificial Sequence: Synthetic polypeptide
EVQLVESGGGLVQPGGSLTLSCAASGSHVSFLSMAWYRQAPGKKRELVAGISADGPTDYIDSVKGRFTISRDNAKNSVYLQMNSLRAEDTAVYYCYAYRWDTRYTYWGQGTLVTVSS

SEQ ID NO: 252 - protein, 117 aa, Artificial Sequence
  Description of Artificial Sequence: Synthetic polypeptide
EVQLVESGGGLVQPGGSLTLSCVASGTSVSFLSMAWYRQAPGKKRELVAGISADGSTTYIDSVKGRFTISRDNAKNSVYLQMNSLRAEDTAVYYCYAYRWTTRRTYWGQGTLVTVSS

SEQ ID NO: 253 - protein, 117 aa, Artificial Sequence
  Description of Artificial Sequence: Synthetic polypeptide
EVQLVESGGGLVQPGGSLTLSCAASGTSVSFLSIAWYRQAPGKKRELVAGISADGSTDYIASVKGRFTISRDNAKNSVYLQMNSLRAEDTAVYYCYAYRWRTRYTYWGQGTLVTVSS

SEQ ID NO: 254 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISLDGSTDYIDSVKGRFTISRDNAKNSVYLQMNSLRAEDTAVYYCYAYRWTGRYTYWGQGTLVTVSS

SEQ ID NO: 255 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTIYIDSVKGRFTISRDNAKNSVYLQMNSLRAEDTAVYYCYAYRWRTRYTYWGQGTLVTVSS

SEQ ID NO: 256 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISAHGSTDYIDSVKGRFTISRDNAKNSVYLQMNSLRAEDTAVYYCYAYRWRTRYTYWGQGTLVTVSS

SEQ ID NO: 257 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISRDGSTDYIDSVKGRFTISRDNAKNSVYLQMNSLRAEDTAVYYCYAYRWITRYTYWGQGTLVTVSS

SEQ ID NO: 258 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISRDGSTDYIDSVKGRFTISRDNAKNSVYLQMNSLRAEDTAVYYCYAYRWITRYTYWGQGTLVTVSS

SEQ ID NO: 259 - protein, 117 aa, Artificial Sequence
  Description of Artificial Sequence: Synthetic polypeptide
EVQLVESGGGLVQPGGSLTLSCAASGSSVVFLSMAWYRQAPGKKRELVAGISADGSMDYIDSVKGRFTISRDNAKNSVYLQMNSLRAEDTAVYYCYAYRWRTRYTYWGQGTLVTVSS

SEQ ID NO: 260 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTDYIDSVKGRFTISRDNAKNSVYLQMNSLRAEDTAVYYCYAYRWTRRYTYWGQGTLVTVSS

SEQ ID NO: 261 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTDYIDSVKGRFTISRDNAKNSVYLQMNSLRAEDTAVYYCYAYSWTTRYTYWGQGTLVTVSS

SEQ ID NO: 262 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISANGSTDYIDSVKGRFTISRDNAKNSVYLQMNSLRAEDTAVYYCYAYRWTNRYTYWGQGTLVTVSS

SEQ ID NO: 263 - protein, 117 aa, Artificial Sequence
  Description of Artificial Sequence: Synthetic polypeptide
EVQLVESGGGLVQPGGSLTLSCAASGSSVSRLSMAWYRQAPGKKRELVAGISANGSTTYIDSVKGRFTISRDNAKNSVYLQMNSLRAEDTAVYYCYAYRWTTRYRYWGQGTLVTVSS

SEQ ID NO: 264 - protein, 117 aa, Artificial Sequence
  Description of Artificial Sequence: Synthetic polypeptide
EVQLVESGGGLVQPGGSLTLSCAASGSSKSFLSMAWYRQAPGKKRELVAGISADGSTSYIDSVKGRFTISRDNAKNSVYLQMNSLRAEDTAVYYCYAYRWTTRYTYWGQGTLVTVSS

SEQ ID NO: 265 - protein, 117 aa, Artificial Sequence
  Description of Artificial Sequence: Synthetic polypeptide
EVQLVESGGGLVQPGGSLTLSCAASGSSVSRLSMAWYRQAPGKKRELVAGISADGSRDYIDSVKGRFTISRDNAKNSVYLQMNSLRAEDTAVYYCYAYRWTTRYKYWGQGTLVTVSS

SEQ ID NO: 266 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTMYIDSVKGRFTISRDNAKNSVYLQMNSLRAEDTAVYYCYAYRWHTRYTYWGQGTLVTVSS

SEQ ID NO: 267 - protein, 117 aa, Artificial Sequence
  Description of Artificial Sequence: Synthetic polypeptide
EVQLVESGGGLVQPGGSLTLSCAASGSGVRFLSMAWYRQAPGKKRELVAGISPDGSTDYIDSVKGRFTISRDNAKNSVYLQMNSLRAEDTAVYYCYAYRWTRRYTYWGQGTLVTVSS

SEQ ID NO: 268 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISGDGSTDYIDSVKGRFTISRDNAKNSVYLQMNSLRAEDTAVYYCYAYRWMTRYTYWGQGTLVTVSS

SEQ ID NO: 269 - protein, 117 aa, Artificial Sequence
  Description of Artificial Sequence: Synthetic polypeptide
EVQLVESGGGLVQPGGSLTLSCAASGSSVHFLSMAWYRQAPGKKRELVAGISRDGSTDYIDSVKGRFTISRDNAKNSVYLQMNSLRAEDTAVYYCYAYRWTTRYRYWGQGTLVTVSS

SEQ ID NO: 270 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISRDGSTDYIDSVKGRFTISRDNAKNSVYLQMNSLRAEDTAVYYCYAYRWSTRYTYWGQGTLVTVSS

SEQ ID NO: 271 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISRDGSTDYIDSVKGRFTISRDNAKNSVYLQMNSLRAEDTAVYYCYAYRWTTRYTFWGQGTLVTVSS

SEQ ID NO: 272 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTDYIDSVKGRFTISRDNAKNSVYLQMNSLRAEDTAVYYCYAYRWRTRYTYWGQGTLVTVSS

SEQ ID NO: 273 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISTDGSTDYIDSVKGRFTISRDNAKNSVYLQMNSLRAEDTAVYYCYAYRWTTRRTYWGQGTLVTVSS

SEQ ID NO: 274 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTSYIDSVKGRFTISRDNAKNSVYLQMNSLRAEDTAVYYCYAYRWATRYTYWGQGTLVTVSS

SEQ ID NO: 275 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTLYIDSVKGRFTISRDNAKNSVYLQMNSLRAEDTAVYYCYAYRWHTRYTYWGQGTLVTVSS

SEQ ID NO: 276 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISRDGSTDYIDSVKGRFTISRDNAKNSVYLQMNSLRAEDTAVYYCYAYRWGTRYTYWGQGTLVTVSS

SEQ ID NO: 277 - protein, 117 aa, Artificial Sequence
  Description of Artificial Sequence: Synthetic polypeptide
EVQLVESGGGLVQPGGSLTLSCAASYSSVSRLSMAWYRQAPGKKRELVAGISADGSTVYIDSVKGRFTISRDNAKNSVYLQMNSLRAEDTAVYYCYAYRWTTRNTYWGQGTLVTVSS

SEQ ID NO: 278 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISTDGSTDYIDSVKGRFTISRDNAKNSVYLQMNSLRAEDTAVYYCYAYRWRTRYTYWGQGTLVTVSS

SEQ ID NO: 279 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTLYIDSVKGRFTISRDNAKNSVYLQMNSLRAEDTAVYYCYAYRWTTRYAYWGQGTLVTVSS

SEQ ID NO: 280 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGRTDYIDSVKGRFTISRDNAKNSVYLQMNSLRAEDTAVYYCYAYRWRTRYTYWGQGTLVTVSS

SEQ ID NO: 281 - protein, 117 aa, Artificial Sequence
  Description of Artificial Sequence: Synthetic polypeptide
EVQLVESGGGLVQPGGSLTLSCVASGTSVSFLSMAWYRQAPGKKRELVAGISADGSTIYIDSVKGRFTISRDNAKNSVYLQMNSLRAEDTAVYYCYAYRWTTRRTYWGQGTLVTVSS

SEQ ID NO: 282 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTLYIDSVKGRFTISRDNAKNSVYLQMNSLRAEDTAVYYCYAYRWTTRRTYWGQGTLVTVSS

SEQ ID NO: 283 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISRDGSTDYIDSVKGRFTISRDNAKNSVYLQMNSLRAEDTAVYYCYAYRWTSRYTYWGQGTLVTVSS

SEQ ID NO: 284 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISKDGSTDYIDSVKGRFTISRDNAKNSVYLQMNSLRAEDTAVYYCYAYRWTTRVTYWGQGTLVTVSS

SEQ ID NO: 285 - protein, 117 aa, Artificial Sequence
  Description of Artificial Sequence: Synthetic polypeptide
EVQLVESGGGLVQPGGSLTLSCAASGSSVSVLSMAWYRQAPGKKRELVAGISADGSTDYIGSVKGRFTISRDNAKNSVYLQMNSLRAEDTAVYYCYAYRWTTRTTYWGQGTLVTVSS

SEQ ID NO: 286 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISVDGSTDYIDSVKGRFTISRDNAKNSVYLQMNSLRAEDTAVYYCYAYRWRTRYTYWGQGTLVTVSS

SEQ ID NO: 287 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTGYIDSVKGRFTISRDNAKNSVYLQMNSLRAEDTAVYYCYAYRWATRYTYWGQGTLVTVSS

SEQ ID NO: 288 - protein, 117 aa, Artificial Sequence
  Description of Artificial Sequence: Synthetic polypeptide
EVQLVESGGGLVQPGGSLTLSCVASGSSVKFLSMAWYRQAPGKKRELVAGISGDGSTTYIDSVKGRFTISRDNAKNSVYLQMNSLRAEDTAVYYCYAYRWTTRRTYWGQGTLVTVSS

SEQ ID NO: 289 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISTDGSTDYIDSVKGRFTISRDNAKNSVYLQMNSLRAEDTAVYYCYALRWTTRYTYWGQGTLVTVSS

SEQ ID NO: 290 - protein, 117 aa, Artificial Sequence
  Description of Artificial Sequence: Synthetic polypeptide
EVQLVESGGGLVQPGGSLTLSCAASGSSVSQLSMAWYRQAPGKKRELVAGISADGSTDYFDSVKGRFTISRDNAKNSVYLQMNSLRAEDTAVYYCYAYRWTTRGTYWGQGTLVTVSS

SEQ ID NO: 291 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTSYIDSVKGRFTISRDNAKNSVYLQMNSLRAEDTAVYYCYAYRWRTRYTYWGQGTLVTVSS

SEQ ID NO: 292 - protein, 117 aa, Artificial Sequence
  Description of Artificial Sequence: Synthetic polypeptide
EVQLVESGGGLVQPGGSLTLSCAASKSSVSFLSMAWYRQAPGKKRELVAGISADGSTDYIDSVKGRFTISRDNAKNSVYLQMNSLRAEDTAVYYCYAYRWTTRATYWGQGTLVTVSS

SEQ ID NO: 293 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTAYIDSVKGRFTISRDNAKNSVYLQMNSLRAEDTAVYYCYAYRWTTRRTYWGQGTLVTVSS

SEQ ID NO: 294 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTVYIDSVKGRFTISRDNAKNSVYLQMNSLRAEDTAVYYCYAYRWPTRYTYWGQGTLVTVSS

SEQ ID NO: 295 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISQDGSTDYIDSVKGRFTISRDNAKNSVYLQMNSLRAEDTAVYYCYAYRWRTRYTYWGQGTLVTVSS

SEQ ID NO: 296 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISNDGSTDYIDSVKGRFTISRDNAKNSVYLQMNSLRAEDTAVYYCYAYRWKTRYTYWGQGTLVTVSS

SEQ ID NO: 297 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISARGSTDYIDSVKGRFTISRDNAKNSVYLQMNSLRAEDTAVYYCYAYRWSTRYTYWGQGTLVTVSS

SEQ ID NO: 298 - protein, 117 aa, Artificial Sequence
  Description of Artificial Sequence: Synthetic polypeptide
EVQLVESGGGLVQPGGSLTLSCAASGSSVSFLSLAWYRQAPGKKRELVAGISADGSTDYIDSVKGRFTISRDNAKNSVYLQMNSLRAEDTAVYYCYAYRWKTRRTYWGQGTLVTVSS

SEQ ID NO: 299 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISRDGSTDYIDSVKGRFTISRDNAKNSVYLQMNSLRAEDTAVYYCYAYRWTTRRTYWGQGTLVTVSS

SEQ ID NO: 300 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSTLYIDSVKGRFTISRDNAKNSVYLQMNSLRAEDTAVYYCYAYRWTTRYRYWGQGTLVTVSS

SEQ ID NO: 301 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTNYIDSVKGRFTISRDNAKNSVYLQMNSLRAEDTAVYYCYAYRWRTRYTYWGQGTLVTVSS

SEQ ID NO: 302 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTVYIDSVKGRFTISRDNAKNSVYLQMNSLRAEDTAVYYCYAYRWTTRYKYWGQGTLVTVSS

SEQ ID NO: 303 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSTTYIDSVKGRFTISRDNAKNSVYLQMNSLRAEDTAVYYCYAYRWKTRYTYWGQGTLVTVSS

SEQ ID NO: 304 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYIGSVKGRFTISRDNAKNSVYLQMNSLRAEDTAVYYCYAYRWTTRVTYWGQGTLVTVSS

SEQ ID NO: 305 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISRDGSTDYIDSVKGRFTISRDNAKNSVYLQMNSLRAEDTAVYYCYAYRWTTRFTYWGQGTLVTVSS

SEQ ID NO: 306 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTTYIDSVKGRFTISRDNAKNSVYLQMNSLRAEDTAVYYCYAYRWTTRFTYWGQGTLVTVSS

SEQ ID NO: 307 - protein, 117 aa, Artificial Sequence
  Description of Artificial Sequence: Synthetic polypeptide
EVQLVESGGGLVQPGGSLTLSCAASGSSVLFLSMAWYRQAPGKKRELVAGVSSDGSTDYIDSVKGRFTISRDNAKNSVYLQMNSLRAEDTAVYYCYAYRWRTRYTYWGQGTLVTVSS

SEQ ID NO: 308 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGHTDYIDSVKGRFTISRDNAKNSVYLQMNSLRAEDTAVYYCYAYRWTTRYTHWGQGTLVTVSS

SEQ ID NO: 309 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTDYFDSVKGRFTISRDNAKNSVYLQMNSLRAEDTAVYYCYAYRWTRRYTYWGQGTLVTVSS

SEQ ID NO: 310 - protein, 117 aa, Artificial Sequence
  Description of Artificial Sequence: Synthetic polypeptide
EVQLVESGGGLVQPGGSLTLSCAASGSSVGFLSMAWYRQAPGKKRELVAGISADGSTVYIDSVKGRFTISRDNAKNSVYLQMNSLRAEDTAVYYCYAYRWTTRYTYWGQGTLVTVSS

SEQ ID NO: 311 - protein, 117 aa, Artificial Sequence
  Description of Artificial Sequence: Synthetic polypeptide
EVQLVESGGGLVQPGGSLTLSCAASGSSVSFMSMAWYRQAPGKKRELVAGISADGSTDYIASVKGRFTISRDNAKNSVYLQMNSLRAEDTAVYYCYAYRWTTRSTYWGQGTLVTVSS

SEQ ID NO: 312 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTDYISSVKGRFTISRDNAKNSVYLQMNSLRAEDTAVYYCYAYSWTTRYTYWGQGTLVTVSS

SEQ ID NO: 313 - protein, 117 aa, Artificial Sequence
  Description of Artificial Sequence: Synthetic polypeptide
EVQLVESGGGLVQPGGSLTLSCAASGSSVTFLSMAWYRQAPGKKRELVAGISADGSTVYIDSVKGRFTISRDNAKNSVYLQMNSLRAEDTAVYYCYAYRWTTRGTYWGQGTLVTVSS

SEQ ID NO: 314 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTVYIDSVKGRFTISRDNAKNSVYLQMNSLRAEDTAVYYCYAYRWKTRYTYWGQGTLVTVSS

SEQ ID NO: 315 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSTTYIDSVKGRFTISRDNAKNSVYLQMNSLRAEDTAVYYCYAYRWTTRFTYWGQGTLVTVSS

SEQ ID NO: 316 - protein, 117 aa, Artificial Sequence
  Description of Artificial Sequence: Synthetic polypeptide
EVQLVESGGGLVQPGGSLTLSCAASGSKVSFMSMAWYRQAPGKKRELVAGISVDGSTDYIDSVKGRFTISRDNAKNSVYLQMNSLRAEDTAVYYCYAYRWRTRYTYWGQGTLVTVSS

SEQ ID NO: 317 - protein, 117 aa, Artificial Sequence
  Description of Artificial Sequence: Synthetic polypeptide
EVQLVESGGGLVQPGGSLTLSCAASGSSVSNLSMAWYRQAPGKKRELVAGISADGSTAYIDSVKGRFTISRDNAKNSVYLQMNSLRAEDTAVYYCYAYRWTTRRTYWGQGTLVTVSS

SEQ ID NO: 318 - protein, 117 aa, Artificial Sequence
  Description of Artificial Sequence: Synthetic polypeptide
EVQLVESGGGLVQPGGSLTLSCAASNSSVSKLSMAWYRQAPGKKRELVAGISADGSTAYIDSVKGRFTISRDNAKNSVYLQMNSLRAEDTAVYYCYAYRWSTRYTYWGQGTLVTVSS

SEQ ID NO: 319 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSKDYIDSVKGRFTISRDNAKNSVYLQMNSLRAEDTAVYYCYAYRWTTRLTYWGQGTLVTVSS

SEQ ID NO: 320 - protein, 117 aa, Artificial Sequence
  Description of Artificial Sequence: Synthetic polypeptide
EVQLVESGGGLVQPGGSLTLSCVASGSQVSFLSMAWYRQAPGKKRELVAGISADGSTDYFDSVKGRFTISRDNAKNSVYLQMNSLRAEDTAVYYCYAYRWTRRYTYWGQGTLVTVSS

SEQ ID NO: 321 - protein, 117 aa, Artificial Sequence
  Description of Artificial Sequence: Synthetic polypeptide
EVQLVESGGGLVQPGGSLTLSCAASGSKVSFMSMAWYRQAPGKKRELVAGISADGSTDYIDSVKGRFTISRDNAKNSVYLQMNSLRAEDTAVYYCYAYRWTTRLTYWGQGTLVTVSS

SEQ ID NO: 322 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTVYIDSVKGRFTISRDNAKNSVYLQMNSLRAEDTAVYYCYAYRWTRRYTYWGQGTLVTVSS

SEQ ID NO: 323 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTVYIDSVKGRFTISRDNAKNSVYLQMNSLRAEDTAVYYCYAYRWTTRRTYWGQGTLVTVSS

SEQ ID NO: 324 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISARGSTDYIDSVKGRFTISRDNAKNSVYLQMNSLRAEDTAVYYCYAYQWTTRYTYWGQGTLVTVSS

SEQ ID NO: 325 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISATGSTDYIDSVKGRFTISRDNAKNSVYLQMNSLRAEDTAVYYCYAYRWTRRYTYWGQGTLVTVSS

SEQ ID NO: 326 - protein, 117 aa, Artificial Sequence
  Description of Artificial Sequence: Synthetic polypeptide
EVQLVESGGGLVQPGGSLTLSCAASGSSVSFLSIAWYRQAPGKKRELVAGISKDGSTDYIDSVKGRFTISRDNAKNSVYLQMNSLRAEDTAVYYCYAYRWTTRMTYWGQGTLVTVSS

SEQ ID NO: 327 - protein, 117 aa, Artificial Sequence
  Description of Artificial Sequence: Synthetic polypeptide
EVQLVESGGGLVQPGGSLTLSCAASGSSSSFLSMAWYRQAPGKKRELVAGISADGSTVYIDSVKGRFTISRDNAKNSVYLQMNSLRAEDTAVYYCYAYRWTTRRTYWGQGTLVTVSS

SEQ ID NO: 328 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISPDGSTDYIDSVKGRFTISRDNAKNSVYLQMNSLRAEDTAVYYCYAYRWTTRYRYWGQGTLVTVSS

SEQ ID NO: 329 - protein, 117 aa, Artificial Sequence
  Description of Artificial Sequence: Synthetic polypeptide
EVQLVESGGGLVQPGGSLTLSCAASGSSVNFLSMAWYRQAPGKKRELVAGISADGSTHYIDSVKGRFTISRDNAKNSVYLQMNSLRAEDTAVYYCYAYRWLTRYTYWGQGTLVTVSS

SEQ ID NO: 330 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYILSVKGRFTISRDNAKNSVYLQMNSLRAEDTAVYYCYAYEWTTRYTYWGQGTLVTVSS

SEQ ID NO: 331 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTDYIHSVKGRFTISRDNAKNSVYLQMNSLRAEDTAVYYCYAYRWRTRYTYWGQGTLVTVSS

SEQ ID NO: 332 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISVDGSTDYIDSVKGRFTISRDNAKNSVYLQMNSLRAEDTAVYYCYAYRWRTRYTYWGQGTLVTVSS

SEQ ID NO: 333 - protein, 117 aa, Artificial Sequence
  Description of Artificial Sequence: Synthetic polypeptide
EVQLVESGGGLVQPGGSLTLSCAASGSSVSFLSVAWYRQAPGKKRELVAGISRDGSTDYIDSVKGRFTISRDNAKNSVYLQMNSLRAEDTAVYYCYAYRWRTRYTYWGQGTLVTVSS

SEQ ID NO: 334 - protein, 117 aa, Artificial Sequence
  Description of Artificial Sequence: Synthetic polypeptide
EVQLVESGGGLVQPGGSLTLSCAASGSQVSFLSMAWYRQAPGKKRELVAGISADGSTVYIDSVKGRFTISRDNAKNSVYLQMNSLRAEDTAVYYCYAYRWSTRYTYWGQGTLVTVSS

SEQ ID NO: 335 - protein, 117 aa, Artificial Sequence
  Description of Artificial Sequence: Synthetic polypeptide
EVQLVESGGGLVQPGGSLTLSCAASGTSVSFLSMAWYRQAPGKKRELVAGISADGSTDYIRSVKGRFTISRDNAKNSVYLQMNSLRAEDTAVYYCYAYRWTTRLTYWGQGTLVTVSS

SEQ ID NO: 336 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTMYIDSVKGRFTISRDNAKNSVYLQMNSLRAEDTAVYYCYAYRWTTRLTYWGQGTLVTVSS

SEQ ID NO: 337 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISTDGSTDYIDSVKGRFTISRDNAKNSVYLQMNSLRAEDTAVYYCYAYKWTTRYTYWGQGTLVTVSS

SEQ ID NO: 338 - protein, 117 aa, Artificial Sequence
  Description of Artificial Sequence: Synthetic polypeptide
EVQLVESGGGLVQPGGSLTLSCAASGSSVSFLSSAWYRQAPGKKRELVAGISADGSTLYIDSVKGRFTISRDNAKNSVYLQMNSLRAEDTAVYYCYAYRWTTRSTYWGQGTLVTVSS

SEQ ID NO: 339 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYIDSVKGRFTISRDNAKNSVYLQMNSLRAEDTAVYYCYAYRWRTRYTYWGQGTLVTVSS

SEQ ID NO: 340 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISATGSTDYIDSVKGRFTISRDNAKNSVYLQMNSLRAEDTAVYYCYAYRWSTRYTYWGQGTLVTVSS

SEQ ID NO: 341 - protein, 117 aa, Artificial Sequence
  Description of Artificial Sequence: Synthetic polypeptide
EVQLVESGGGLVQPGGSLTLSCAASGSTVSFLSMAWYRQAPGKKRELVAGISHDGSTDYIDSVKGRFTISRDNAKNSVYLQMNSLRAEDTAVYYCYAYRWTTRYTYWGQGTLVTVSS

SEQ ID NO: 342 - protein, 117 aa, Artificial Sequence
  Description of Artificial Sequence: Synthetic polypeptide
EVQLVESGGGLVQPGGSLTLSCAASGSSVQFLSMAWYRQAPGKKRELVAGISYDGSTDYIDSVKGRFTISRDNAKNSVYLQMNSLRAEDTAVYYCYAYRWRTRYTYWGQGTLVTVSS

SEQ ID NO: 343 - protein, 117 aa, Artificial Sequence
  Description of Artificial Sequence: Synthetic polypeptide
EVQLVESGGGLVQPGGSLTLSCAASRSSVSFLSMAWYRQAPGKKRELVAGISTDGSTDYIDSVKGRFTISRDNAKNSVYLQMNSLRAEDTAVYYCYAYRWLTRYTYWGQGTLVTVSS

SEQ ID NO: 344 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSTAYIDSVKGRFTISRDNAKNSVYLQMNSLRAEDTAVYYCYAYRWRTRYTYWGQGTLVTVSS

SEQ ID NO: 345 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTDYIESVKGRFTISRDNAKNSVYLQMNSLRAEDTAVYYCYAYRWTTRYTYWGQGTLVTVSS

SEQ ID NO: 346 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISIDGSTDYIKSVKGRFTISRDNAKNSVYLQMNSLRAEDTAVYYCYAYRWTTRYRYWGQGTLVTVSS

SEQ ID NO: 347 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSKDYIDSVKGRFTISRDNAKNSVYLQMNSLRAEDTAVYYCYAYRWTTRYTYWGQGTLVTVSS

SEQ ID NO: 348 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTVYIDSVKGRFTISRDNAKNSVYLQMNSLRAEDTAVYYCYAYRWPTRYTYWGQGTLVTVSS

SEQ ID NO: 349 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISRDGSTDYIDSVKGRFTISRDNAKNSVYLQMNSLRAEDTAVYYCYAYRWTTRHTYWGQGTLVTVSS

SEQ ID NO: 350 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYIHSVKGRFTISRDNAKNSVYLQMNSLRAEDTAVYYCYAYRWTRRYTYWGQGTLVTVSS

SEQ ID NO: 351 - protein, 117 aa, Artificial Sequence
  Description of Artificial Sequence: Synthetic polypeptide
EVQLVESGGGLVQPGGSLTLSCAASGSSVSILSMAWYRQAPGKKRELVAGISADGSTIYIDSVKGRFTISRDNAKNSVYLQMNSLRAEDTAVYYCYAYRWHTRYTYWGQGTLVTVSS

SEQ ID NO: 352 - protein, 117 aa, Artificial Sequence
  Description of Artificial Sequence: Synthetic polypeptide
EVQLVESGGGLVQPGGSLTLSCAASGSSVSFLSVAWYRQAPGKKRELVAGISANGSTDYIDSVKGRFTISRDNAKNSVYLQMNSLRAEDTAVYYCYAYRWTNRYTYWGQGTLVTVSS

SEQ ID NO: 353 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISTDGSTDYIDSVKGRFTISRDNAKNSVYLQMNSLRAEDTAVYYCYAYRWTTRYRYWGQGTLVTVSS

SEQ ID NO: 354 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISYDGSTDYIDSVKGRFTISRDNAKNSVYLQMNSLRAEDTAVYYCYAYRWTTRRTYWGQGTLVTVSS

SEQ ID NO: 355 - protein, 117 aa, Artificial Sequence
  Description of Artificial Sequence: Synthetic polypeptide
EVQLVESGGGLVQPGGSLTLSCAASGHSVSFLSMAWYRQAPGKKRELVAGISADGSTDYIASVKGRFTISRDNAKNSVYLQMNSLRAEDTAVYYCYAYRWSTRYTYWGQGTLVTVSS

SEQ ID NO: 356 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTDYIGSVKGRFTISRDNAKNSVYLQMNSLRAEDTAVYYCYAYRWSTRYTYWGQGTLVTVSS

SEQ ID NO: 357 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISANGSTDYYDSVKGRFTISRDNAKNSVYLQMNSLRAEDTAVYYCYAYRWRTRYTYWGQGTLVTVSS

SEQ ID NO: 358 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTSYIDSVKGRFTISRDNAKNSVYLQMNSLRAEDTAVYYCYAYRWTTRYTYWGQGTLVTVSS

SEQ ID NO: 359 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGVSADGSTDYIDSVKGRFTISRDNAKNSVYLQMNSLRAEDTAVYYCYAYEWTTRYTYWGQGTLVTVSS

SEQ ID NO: 360 - protein, 117 aa, Artificial Sequence
  Description of Artificial Sequence: Synthetic polypeptide
EVQLVESGGGLVQPGGSLTLSCAASGSSVSRLSMAWYRQAPGKKRELVAGISARGSTDYIDSVKGRFTISRDNAKNSVYLQMNSLRAEDTAVYYCYAYRWTTRSTYWGQGTLVTVSS

SEQ ID NO: 361 - protein, 117 aa, Artificial Sequence
  Description of Artificial Sequence: Synthetic polypeptide
EVQLVESGGGLVQPGGSLTLSCAASGRSVSFLSMAWYRQAPGKKRELVAGISADGSTIYIDSVKGRFTISRDNAKNSVYLQMNSLRAEDTAVYYCYAYRWTTRYTYWGQGTLVTVSS

SEQ ID NO: 362 - protein, 117 aa, Artificial Sequence
  Description of Artificial Sequence: Synthetic polypeptide
EVQLVESGGGLVQPGGSLTLSCAASGRSVSFLSMAWYRQAPGKKRELVAGISANGSTDYIDSVKGRFTISRDNAKNSVYLQMNSLRAEDTAVYYCYAYRWSTRYTYWGQGTLVTVSS

SEQ ID NO: 363 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYVDSVKGRFTISRDNAKNSVYLQMNSLRAEDTAVYYCYAYRWSTRYTYWGQGTLVTVSS

SEQ ID NO: 364 - protein, 117 aa, Artificial Sequence
  Description of Artificial Sequence: Synthetic polypeptide
EVQLVESGGGLVQPGGSLTLSCAASGSSVSKLSMAWYRQAPGKKRELVAGISADGSTDYRDSVKGRFTISRDNAKNSVYLQMNSLRAEDTAVYYCYAYRWTYRYTYWGQGTLVTVSS

SEQ ID NO: 365 - protein, 117 aa, Artificial Sequence
  Description of Artificial Sequence: Synthetic polypeptide
EVQLVESGGGLVQPGGSLTLSCAASGSSVSRLSMAWYRQAPGKKRELVAGISVDGSTDYIDSVKGRFTISRDNAKNSVYLQMNSLRAEDTAVYYCYAYRWTTRLTYWGQGTLVTVSS

SEQ ID NO: 366 - protein, 117 aa, Artificial Sequence
  Description of Artificial Sequence: Synthetic polypeptide
EVQLVESGGGLVQPGGSLTLSCAASGSSVKFLSLAWYRQAPGKKRELVAGISADGSTDYILSVKGRFTISRDNAKNSVYLQMNSLRAEDTAVYYCYAYEWTTRYTYWGQGTLVTVSS

SEQ ID NO: 367 - protein, 117 aa, Artificial Sequence
  Description of Artificial Sequence: Synthetic polypeptide
EVQLVESGGGLVQPGGSLTLSCAASGSSVSRLSLAWYRQAPGKKRELVAGISVDGSTDYIDSVKGRFTISRDNAKNSVYLQMNSLRAEDTAVYYCYAYRWTTRLTYWGQGTLVTVSS

SEQ ID NO: 368 - protein, 119 aa, Artificial Sequence
  Description of Artificial Sequence: Synthetic polypeptide
EVQLVESGGGLVQPGGSLTLSCVASGTSSSINAMGWYRRAPGKQRELVAGISSDGSKVFNESVKGRFTISRDNAKNSVYLQMNSLRAEDTAVYYCYYFRPAAGSPMRYWGQGTLVTVSS

SEQ ID NO: 369 - protein, 119 aa, Artificial Sequence
  Description of Artificial Sequence: Synthetic polypeptide
EVQLVESGGGLVQPGGSLTLSCVASGTTSSINAIGWYRRAPGKQRELVAGISSDGSEVYTDSVKGRFTISRDNAKNSVYLQMNSLRAEDTAVYYCYYFRTVDGSPLRYWGQGTLVTVSS

SEQ ID NO: 370 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDDSNVYYESVKGRFTISRDNAKNSVYLQMNSLRAEDTAVYYCYYFRTVSGSSKRYWGQGTLVTVSS

SEQ ID NO: 371 - protein, 119 aa, Artificial Sequence
  Description of Artificial Sequence: Synthetic polypeptide
EVQLVESGGGLVQPGGSLTLSCVASGQTYRVNAFGWYRRAPGKQRELVAGISSDGSKVYADSVKGRFTISRDNAKNSVYLQMNSLRAEDTAVYYCYYFSAGSGTEMSYWGQGTLVTVSS

SEQ ID NO: 372 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDESTLYVDSVKGRFTISRDNAKNSVYLQMNSLRAEDTAVYYCYYFGSLSGSSTTYWGQGTLVTVSS

SEQ ID NO: 373 - protein, 119 aa, Artificial Sequence
  Description of Artificial Sequence: Synthetic polypeptide
EVQLVESGGGLVQPGGSLTLSCVASGSASLTNATGWYRRAPGKQRELVAGISSDDSKVYSDSVKGRFTISRDNAKNSVYLQMNSLRAEDTAVYYCYYFGSVSGSWTRYWGQGTLVTVSS

SEQ ID NO: 374 - protein, 119 aa, Artificial Sequence
  Description of Artificial Sequence: Synthetic polypeptide
EVQLVESGGGLVQPGGSLTLSCVASGYPSLNNAMGWYRRAPGKQRELVAGISSDGSQVYGASVKGRFTISRDNAKNSVYLQMNSLRAEDTAVYYCYYFRLVSGSSMSYWGQGTLVTVSS

SEQ ID NO: 375 - protein, 119 aa, Artificial Sequence
  Description of Artificial Sequence: Synthetic polypeptide
EVQLVESGGGLVQPGGSLTLSCVASGSSSTINAIGWYRRAPGKQRELVAGISSDGSKVYADSVKGRFTISRDNAKNSVYLQMNSLRAEDTAVYYCYYFRTGSGTSKSYWGQGTLVTVSS

SEQ ID NO: 376 - protein, 119 aa, Artificial Sequence
  Description of Artificial Sequence: Synthetic polypeptide
EVQLVESGGGLVQPGGSLTLSCVASGSTSYINAMGWYRRAPGKQRELVAGISSDGSNMYADSVKGRFTISRDNAKNSVYLQMNSLRAEDTAVYYCYYFSNMSGTTRRYWGQGTLVTVSS

SEQ ID NO: 377 - protein, 119 aa, Artificial Sequence
  Description of Artificial Sequence: Synthetic polypeptide
EVQLVESGGGLVQPGGSLTLSCVASGSTSSVNALGWYRRAPGKQRELVAGISSDGSKVYTDSVKGRFTISRDNAKNSVYLQMNSLRAEDTAVYYCYYFRTVPGSAMGYWGQGTLVTVSS

SEQ ID NO: 378 - protein, 119 aa, Artificial Sequence
  Description of Artificial Sequence: Synthetic polypeptide
EVQLVESGGGLVQPGGSLTLSCVASGSTSLSNAVGWYRRAPGKQRELVAGISSDGSKVSAESVKGRFTISRDNAKNSVYLQMNSLRAEDTAVYYCYYFRAESGSSMGYWGQGTLVTVSS

SEQ ID NO: 379 - protein, 119 aa, Artificial Sequence
  Description of Artificial Sequence: Synthetic polypeptide
EVQLVESGGGLVQPGGSLTLSCVASGSTSSTNAIGWYRRAPGKQRELVAGISSDGSKVYDDSVKGRFTISRDNAKNSVYLQMNSLRAEDTAVYYCYYFRTLYGSSRSYWGQGTLVTVSS

SEQ ID NO: 380 - protein, 119 aa, Artificial Sequence
  Description of Artificial Sequence: Synthetic polypeptide
EVQLVESGGGLVQPGGSLTLSCVASGLTSTINAMGWYRRAPGKQRELVAGISSDGSKVYDDSVKGRFTISRDNAKNSVYLQMNSLRAEDTAVYYCYYFSPFSGSDTGYWGQGTLVTVSS

SEQ ID NO: 381 - protein, 119 aa, Artificial Sequence
  Description of Artificial Sequence: Synthetic polypeptide
EVQLVESGGGLVQPGGSLTLSCVASGVSPSKNAIGWYRRAPGKQRELVAGISSDGSAVYVGSVKGRFTISRDNAKNSVYLQMNSLRAEDTAVYYCYYFSTFSGSSISYWGQGTLVTVSS

SEQ ID NO: 382 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSYVYSESVKGRFTISRDNAKNSVYLQMNSLRAEDTAVYYCYYFRTLAGSEMRYWGQGTLVTVSS

SEQ ID NO: 383 - protein, 119 aa, Artificial Sequence
  Description of Artificial Sequence: Synthetic polypeptide
EVQLVESGGGLVQPGGSLTLSCVASGSTTMNNAMAWYRRAPGKQRELVAGISSDSSHVYADSVKGRFTISRDNAKNSVYLQMNSLRAEDTAVYYCYYFRTVSGSGVRYWGQGTLVTVSS

SEQ ID NO: 384 - protein, 119 aa, Artificial Sequence
  Description of Artificial Sequence: Synthetic polypeptide
EVQLVESGGGLVQPGGSLTLSCVASGSTSKINAIGWYRRAPGKQRELVAGISSDSSIVYTDSVKGRFTISRDNAKNSVYLQMNSLRAEDTAVYYCYYFRPGAGHSNSYWGQGTLVTVSS

SEQ ID NO: 385 - protein, 119 aa, Artificial Sequence
  Description of Artificial Sequence: Synthetic polypeptide
EVQLVESGGGLVQPGGSLTLSCVASGQTTALNAMGWYRRAPGKQRELVAGISSDGSEVNTDSVKGRFTISRDNAKNSVYLQMNSLRAEDTAVYYCYYFRRASGTAMSYWGQGTLVTVSS

SEQ ID NO: 386 - protein, 119 aa, Artificial Sequence
  Description of Artificial Sequence: Synthetic polypeptide
EVQLVESGGGLVQPGGSLTLSCVASGATSSINAIGWYRRAPGKQRELVAGISSDGSKLSSDSVKGRFTISRDNAKNSVYLQMNSLRAEDTAVYYCYYFTSASGTDLSYWGQGTLVTVSS

SEQ ID NO: 387 - protein, 119 aa, Artificial Sequence
  Description of Artificial Sequence: Synthetic polypeptide
EVQLVESGGGLVQPGGSLTLSCVASGSTSTINAMGWYRRAPGKQRELVAGISSDNSKVYADSVKGRFTISRDNAKNSVYLQMNSLRAEDTAVYYCYYFRSANGSSKRYWGQGTLVTVSS

SEQ ID NO: 388 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSRVYFDSVKGRFTISRDNAKNSVYLQMNSLRAEDTAVYYCYYFKTIAGAGMRYWGQGTLVTVSS

SEQ ID NO: 389 - protein, 119 aa, Artificial Sequence
  Description of Artificial Sequence: Synthetic polypeptide
EVQLVESGGGLVQPGGSLTLSCVASGSTSLVNAMGWYRRAPGKQRELVAGISSDGSLVYAESVKGRFTISRDNAKNSVYLQMNSLRAEDTAVYYCYYFRYGSGSSLSYWGQGTLVTVSS

SEQ ID NO: 390 - protein, 119 aa, Artificial Sequence
  Description of Artificial Sequence: Synthetic polypeptide
EVQLVESGGGLVQPGGSLTLSCVASGSTSLNNAIGWYRRAPGKQRELVAGISSDGSVVYVDSVKGRFTISRDNAKNSVYLQMNSLRAEDTAVYYCYYFRTVPGASMKYWGQGTLVTVSS

SEQ ID NO: 391 - protein, 119 aa, Artificial Sequence
  Description of Artificial Sequence: Synthetic polypeptide
EVQLVESGGGLVQPGGSLTLSCVASGSTSPVNAMAWYRRAPGKQRELVAGISSDGSKVYVDSVKGRFTISRDNAKNSVYLQMNSLRAEDTAVYYCYYFRTVDGSAISYWGQGTLVTVSS

SEQ ID NO: 392 - protein, 119 aa, Artificial Sequence
  Description of Artificial Sequence: Synthetic polypeptide
EVQLVESGGGLVQPGGSLTLSCVASGTTSSMNAIGWYRRAPGKQRELVAGISSDGSKLYDESVKGRFTISRDNAKNSVYLQMNSLRAEDTAVYYCYYFRTVKGSGGSYWGQGTLVTVSS

SEQ ID NO: 393 - protein, 119 aa, Artificial Sequence
  Description of Artificial Sequence: Synthetic polypeptide
EVQLVESGGGLVQPGGSLTLSCVASGETSSINAMAWYRRAPGKQRELVAGISSDYSKLYADSVKGRFTISRDNAKNSVYLQMNSLRAEDTAVYYCYYFRTVSGSSRGYWGQGTLVTVSS

SEQ ID NO: 394 - protein, 119 aa, Artificial Sequence
  Description of Artificial Sequence: Synthetic polypeptide
EVQLVESGGGLVQPGGSLTLSCVASGSTSTINAIGWYRRAPGKQRELVAGISSDSSKVYTESVKGRFTISRDNAKNSVYLQMNSLRAEDTAVYYCYYFRPGPGSQMAYWGQGTLVTVSS

SEQ ID NO: 395 - protein, 119 aa, Artificial Sequence
  Description of Artificial Sequence: Synthetic polypeptide
EVQLVESGGGLVQPGGSLTLSCVASGSTYSMNAMGWYRRAPGKQRELVAGISSDGSQVYVDSVKGRFTISRDNAKNSVYLQMNSLRAEDTAVYYCYYFRTVAGSASGYWGQGTLVTVSS

SEQ ID NO: 396 - protein, 119 aa, Artificial Sequence; identical to SEQ ID NO: 227
  Description of Artificial Sequence: Synthetic polypeptide

SEQ ID NO: 397 - protein, 119 aa, Artificial Sequence
  Description of Artificial Sequence: Synthetic polypeptide
EVQLVESGGGLVQPGGSLTLSCVASGSTSTINAIGWYRRAPGKQRELVAGISSDGSKVYVDSVKGRFTISRDNAKNSVYLQMNSLRAEDTAVYYCYYFINLKGSSMAYWGQGTLVTVSS

SEQ ID NO: 398 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYADSVKGRFTISRDNAKNSVYLQMNSLRAEDTAVYYCYYFRMVTGSYGGYWGQGTLVTVSS

SEQ ID NO: 399 - protein, 119 aa, Artificial Sequence
  Description of Artificial Sequence: Synthetic polypeptide
EVQLVESGGGLVQPGGSLTLSCVASGSISSINAMGWYRRAPGKQRELVAGISSDGSSVYADSVKGRFTISRDNAKNSVYLQMNSLRAEDTAVYYCYYFKSSYGLPMRYWGQGTLVTVSS

SEQ ID NO: 400 - protein, 119 aa, Artificial Sequence
  Description of Artificial Sequence: Synthetic polypeptide
EVQLVESGGGLVQPGGSLTLSCVASGSTQVNNAMAWYRRAPGKQRELVAGISSDGSQVYYGSVKGRFTISRDNAKNSVYLQMNSLRAEDTAVYYCYYFKTVSGQSLRYWGQGTLVTVSS

SEQ ID NO: 401 - protein, 119 aa, Artificial Sequence
  Description of Artificial Sequence: Synthetic polypeptide
EVQLVESGGGLVQPGGSLTLSCVASGSTASFNAMAWYRRAPGKQRELVAGISSDGSKVYTDSVKGRFTISRDNAKNSVYLQMNSLRAEDTAVYYCYYFRTVTGRAARYWGQGTLVTVSS

SEQ ID NO: 402 - protein, 119 aa, Artificial Sequence
  Description of Artificial Sequence: Synthetic polypeptide
EVQLVESGGGLVQPGGSLTLSCVASGSPLSINAIGWYRRAPGKQRELVAGISSDGSKVSADSVKGRFTISRDNAKNSVYLQMNSLRAEDTAVYYCYYFGPAIGASRTYWGQGTLVTVSS

SEQ ID NO: 403 - protein, 119 aa, Artificial Sequence
  Description of Artificial Sequence: Synthetic polypeptide
EVQLVESGGGLVQPGGSLTLSCVASGSTTFINAIGWYRRAPGKQRELVAGISSDGSKVYEDSVKGRFTISRDNAKNSVYLQMNSLRAEDTAVYYCYYFRTVSGAPKSYWGQGTLVTVSS

SEQ ID NO: 404 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDRSKVYADSVKGRFTISRDNAKNSVYLQMNSLRAEDTAVYYCYYFHTVSGSSMSYWGQGTLVTVSS

SEQ ID NO: 405 - protein, 119 aa, Artificial Sequence
  Description of Artificial Sequence: Synthetic polypeptide
EVQLVESGGGLVQPGGSLTLSCVASGETDTINAVGWYRRAPGKQRELVAGISSDGSKVYAESVKGRFTISRDNAKNSVYLQMNSLRAEDTAVYYCYYFRRLEGYSNRYWGQGTLVTVSS

SEQ ID NO: 406 - protein, 119 aa, Artificial Sequence
  Description of Artificial Sequence: Synthetic polypeptide
EVQLVESGGGLVQPGGSLTLSCVASGSTSPINAIGWYRRAPGKQRELVAGISSDGSVVTTESVKGRFTISRDNAKNSVYLQMNSLRAEDTAVYYCYYFRTGSGSSMGYWGQGTLVTVSS

SEQ ID NO: 407 - protein, 119 aa, Artificial Sequence
  Description of Artificial Sequence: Synthetic polypeptide
EVQLVESGGGLVQPGGSLTLSCVASGSITSSNAMGWYRRAPGKQRELVAGISSDGSHVHQESVKGRFTISRDNAKNSVYLQMNSLRAEDTAVYYCYYFTTVTGSSMSYWGQGTLVTVSS

SEQ ID NO: 408 - protein, 117 aa, Artificial Sequence
  Description of Artificial Sequence: Synthetic polypeptide
EVQLVESGGGLVQPGGSLTLSCAASRYSVSNLSMAWYRQAPGKKRELVAGISADGSTVYVESVKGRFTISRDNAKNSVYLQMNSLRAEDTAVYYCYAYYWTERRPYWGQGTLVTVSS

SEQ ID NO: 409 - protein, 117 aa, Artificial Sequence
  Description of Artificial Sequence: Synthetic polypeptide
EVQLVESGGGLVQPGDSLTLSCAASMSTVSVLSMAWYRQAPGKKRELVAGISSDGSTVYIDSVKGRFTISRDNAKNSVYLQMNSLRAEDTAIYYCYAYSWDDAHPYWGQGTLVTVSS

SEQ ID NO: 410 - protein, 117 aa, Artificial Sequence
  Description of Artificial Sequence: Synthetic polypeptide
EVQLVESGGGLVQPGGSLTLSCAASDSYVSLLSMAWYRQAPGKKRELVAGISVDGSTHYVASVKGRFTISRDNAKNSVYLQMNSLRAEDTAVYYCYAYRWMTRLTYWGQGTLVTVSS

SEQ ID NO: 411 - protein, 117 aa, Artificial Sequence
  Description of Artificial Sequence: Synthetic polypeptide
EVQLVESGGGLVQPGGSLTLSCAASDSAVSVLSIAWYRQAPGKKRELVAGISTDGSKHYIDSVKGRFTISRDNAKNSVYLQMNSLRAEDTAVYYCYAYDWADAQPYWGQGTLVTVSS

SEQ ID NO: 412 - protein, 117 aa, Artificial Sequence
  Description of Artificial Sequence: Synthetic polypeptide
EVQLVESGGGLVQPGGSLTLSCAASHSSVTSLSLAWYRQAPGKKRELVAGISYDGSKYYAESVKGRFTISRDNAKNSVYLQMNSLRAEDTAVYYCYAYSWTDRLPYWGQGTLVTVSS

SEQ ID NO: 413 - protein, 117 aa, Artificial Sequence
  Description of Artificial Sequence: Synthetic polypeptide
EVQLVESGGGLVQPGGSLTLSCAASDSVVKFLSMAWYRQAPGKKRELVAGISANGSRTYMESVKGRFTISRDNAKNSVYLQMNSLRAEDTAVYYCYAYRWATRLPYWGQGTLVTVSS

SEQ ID NO: 414 - protein, 117 aa, Artificial Sequence
  Description of Artificial Sequence: Synthetic polypeptide
EVQLVESGGGLVQPGGSLTLSCAASDPSVWNLSMAWYRQAPGKKRELVAGISPDGSTDYVDSVKGRFTISRDNAKNSVYLQMNSLRAEDTAVYYCYAYKWSNRLPYWGQGTLVTVSS

SEQ ID NO: 415 - protein, 117 aa, Artificial Sequence
  Description of Artificial Sequence: Synthetic polypeptide
EVQLVESGGGLVQPGGSLTLSCAASGTSVMLLSLAWYRQAPGKKRELVAGISPNGSAVYTESVKGRFTISRDNAKNSVYLQMNSLRAEDTAVYYCYAYGWKTRQPYWGQGTLVTVSS

SEQ ID NO: 416 - protein, 117 aa, Artificial Sequence
  Description of Artificial Sequence: Synthetic polypeptide
EVQLVESGGGLVQPGGSLTLSCAASSSPVSNLSLAWYRQAPGKKRELVAGISPDGSTAYMESVKGRFTISRDNAKNSVYLQMNSLRAEDTAVYYCYAYRWPNRRGYWGQGTLVTVSS

SEQ ID NO: 417 - protein, 117 aa, Artificial Sequence
  Description of Artificial Sequence: Synthetic polypeptide
EVQLVESGGGLVQPGGSLTLSCAASWRSVLLLSVAWYRQAPGKKRELVAGISNDGSTDYIDSVKGRFTISRDNAKNSVYLQMNSLRAEDTAVYYCYAYDWTTRQRYWGQGTLVTVSS

SEQ ID NO: 418 - protein, 117 aa, Artificial Sequence
  Description of Artificial Sequence: Synthetic polypeptide
EVQLVESGGGLVQPGGSLTLSCAASSSSVQYLSMAWYRQAPGKKRELVAGISTDGSAVYFDSVKGRFTISRDNAKNSVYLQMNSLRAEDTAVYYCYAYNWSYAQPYWGQGTLVTVSS

SEQ ID NO: 419 - protein, 117 aa, Artificial Sequence
  Description of Artificial Sequence: Synthetic polypeptide
EVQLVESGGGLVQPGGSLTLSCAASGTSVSLLSLAWYRQAPGKKRELVAGISTGGSTHYIESVKGRFTISRDNAKNSVYLQMNSLRAEDTAVYYCYAYNWTDSLQYWGQGTLVTVSS

SEQ ID NO: 420 - protein, 117 aa, Artificial Sequence
  Description of Artificial Sequence: Synthetic polypeptide
EVQLVESGGGLVQPGGSLTLSCAASLSSVSNLSIAWYRQAPGKKRELVAGISTDGSTVYIDSVKGRFTISRDNAKNSVYLQMNSLRAEDTAVYYCYAYSWTTSLPYWGQGTLVTVSS

SEQ ID NO: 421 - protein, 117 aa, Artificial Sequence
  Description of Artificial Sequence: Synthetic polypeptide
EVQLVESGGGLVQPGGSLTLSCAASMYSVSFLSMAWYRQAPGKKRELVAGISNEGSTYYMDSVKGRFTISRDNAKNSVYLQMNSLRAEDTAVYYCYAYKWRSRSTYWGQGTLVTVSS

SEQ ID NO: 422 - protein, 117 aa, Artificial Sequence
  Description of Artificial Sequence: Synthetic polypeptide
EVQLVESGGGLVQPGGSLTLSCAASKSSVSHLSLAWYRQAPGKKRELVAGISADGSHVYTNSVKGRFTISRDNAKNSVYLQMNSLRAEDTAVYYCYAYSQTTRDPYWGQGTLVTVSS

SEQ ID NO: 423 - protein, 117 aa, Artificial Sequence
  Description of Artificial Sequence: Synthetic polypeptide
EVQLVESGGGLVQPGGSLTLSCAASYTSVLDLSIAWYRQAPGKKRELVAGISDDGSRYYTDSVKGRFTISRDNAKNSVYLQMNSLRAEDTAVYYCYAYRWTARDTYWGQGTLVTVSS

SEQ ID NO: 424 - protein, 117 aa, Artificial Sequence
  Description of Artificial Sequence: Synthetic polypeptide
EVQLVESGGGLVQPGGSLTLSCAASMSDVSFLSMAWYRQAPGKKRELVAGISAEGSTLYMESVKGRFTISRDNAKNSVYLQMNSLRAEDTAVYYCYAYRWTSRLSYWGQGTLVTVSS

SEQ ID NO: 425 - protein, 117 aa, Artificial Sequence
  Description of Artificial Sequence: Synthetic polypeptide
EVQLVESGGGLVQPGGSLTLSCAASESSVSFLSSAWYRQAPGKKRELVAGISTDGSTVYIDSVKGRFTISRDNAKNSVYLQMNSLRAEDTAVYYCYAYSWTTRSRYWGQGTLVTVSS

SEQ ID NO: 426 - protein, 117 aa, Artificial Sequence
  Description of Artificial Sequence: Synthetic polypeptide
EVQLVESGGGLVQPGGSLTLSCAASGDSVSLLSMAWYRQAPGKKRELVAGISANGSTSYIDSVKGRFTISRDNAKNSVYLQMNSLRAEDTAVYYCYAYNWTSRYRYWGQGTLVTVSS

SEQ ID NO: 427 - protein, 117 aa, Artificial Sequence
  Description of Artificial Sequence: Synthetic polypeptide
EVQLVESGGGLVQPGGSLTLSCAASGSDVWYLSLAWYRQAPGKKRELVAGISDDGSRHYIESVKGRFTISRDNAKNSVYLQMNSLRAEDTAVYYCYAYSWKTRFPYWGQGTLVTVSS

SEQ ID NO: 428 - protein, 117 aa, Artificial Sequence
  Description of Artificial Sequence: Synthetic polypeptide
EVQLVESGGGLVQPGGSLTLSCAASKSAVAFLSIAWYRQAPGKKRELVAGISPDGSTVYIESVKGRFTISRDNAKNSVYLQMNSLRAEDTAVYYCYAYSWTTRYPYWGQGTLVTVSS

SEQ ID NO: 429 - protein, 117 aa, Artificial Sequence
  Description of Artificial Sequence: Synthetic polypeptide
EVQLVESGGGLVQPGGSLTLSCAASFSAVAYLSMAWYRQAPGKKRELVAGISDDGSTVYVDSVKGRFTISRDNAKNSVYLQMNSLRAEDTAVYYCYAYEWTNALPYWGQGTLVTVSS

SEQ ID NO: 430 - protein, 117 aa, Artificial Sequence
  Description of Artificial Sequence: Synthetic polypeptide
EVQLVESGGGLVQPGGSLTLSCAASVYSVYDLSTAWYRQAPGKKRELVAGISDDGSTVYFDSVKGRFTISRDNAKNSVYLQMNSLRAEDTAVYYCYAYSWITRSPYWGQGTLVTVSS

SEQ ID NO: 431 - protein, 117 aa, Artificial Sequence
  Description of Artificial Sequence: Synthetic polypeptide
EVQLVESGGGLVQPGGSLTLSCAASGDSVSFLSMAWYRQAPGKKRELVAGISDEGSTVYIGSVKGRFTISRDNAKNSVYLQMNSLRAEDTAVYYCYAYSWTTRRQYWGQGTLVTVSS

SEQ ID NO: 432 - protein, 117 aa, Artificial Sequence
  Description of Artificial Sequence: Synthetic polypeptide
EVQLVESGGGLVQPGGSLTLSCAASSSSVSLLSLAWYRQAPGKKRELVAGISDDGSIVYMDSVKGRFTISRDNAKNSVYLQMNSLRAEDTAVYYCYAYSWITRSPYWGQGTLVTVSS

SEQ ID NO: 433 - protein, 117 aa, Artificial Sequence
  Description of Artificial Sequence: Synthetic polypeptide
EVQLVESGGGLVQPGGSLTLSCAASADSVSFLSIAWYRQAPGKKRELVAGISDDGSKHYFDSVKGRFTISRDNAKNSVYLQMNSLRAEDTAVYYCYAYRWEESRQYWGQGTLVTVSS

SEQ ID NO: 434 - protein, 117 aa, Artificial Sequence
  Description of Artificial Sequence: Synthetic polypeptide
EVQLVESGGGLVQPGGSLTLSCAASASSVTLLSIAWYRQAPGKKRELVAGISTDGSTDYLHSVKGRFTISRDNAKNSVYLQMNSLRAEDTAVYYCYAYTWTTRLPYWGQGTLVTVTS

SEQ ID NO: 435 - protein, 117 aa, Artificial Sequence; identical to SEQ ID NO: 433
  Description of Artificial Sequence: Synthetic polypeptide

SEQ ID NO: 436 - protein, 117 aa, Artificial Sequence
  Description of Artificial Sequence: Synthetic polypeptide
EVQLVESGGGLVQPGGSLTLSCAASGTSVWLLSMAWYRQAPGKKRELVAGISYDGSTVYVESVKGRFTISRDNAKNSVYLQMNSLRAEDTAVYYCYAYSWTTRQPYWGQGTLVTVSS

SEQ ID NO: 437 - protein, 117 aa, Artificial Sequence
  Description of Artificial Sequence: Synthetic polypeptide
EVQLVESGGGLVQPGGSLTLSCAASGSSVSILSIAWYRQAPGKKRELVAGISDDGSTVYIDSVKGRFTISRDNAKNSVYLQMNSLRAEDTAVYYCYAYVWGTRLPYWGQGTLVTVSS

SEQ ID NO: 438 - protein, 117 aa, Artificial Sequence
  Description of Artificial Sequence: Synthetic polypeptide
EVQLVESGGGLVQPGGSLTLSCAASGTAVSNLSIAWYRQAPGKKRELVAGISDDGSTVYVDSVKGRFTISRDNAKNSVYLQMNSLRAEDTAVYYCYAYEWTNALPYWGQGTLVTVSS

SEQ ID NO: 439 - protein, 117 aa, Artificial Sequence
  Description of Artificial Sequence: Synthetic polypeptide
EVQLVESGGGLVQPGGSLTLSCAASGSAVSMLSLAWYRQAPGKKRELVAGISDDGSQVYIDSVKGRFTISRDNAKNSVYLQMNSLRAEDTAVYYCYAYRWEDALTYWGQGTLVTVSS

SEQ ID NO: 440 - protein, 117 aa, Artificial Sequence
  Description of Artificial Sequence: Synthetic polypeptide
EVQLVESGGGLVQPGGSLTLSCAASGMTVFFLSMAWYRQAPGKKRELVAGISVDGSTVYSDSVKGRFTISRDNAKNSVYLQMNSLRAEDTAVYYCYAYSWTTRYPYWGQGTLVTVSS

SEQ ID NO: 441 - protein, 117 aa, Artificial Sequence
  Description of Artificial Sequence: Synthetic polypeptide
EVQLVESGGGLVQPGGSLTLSCAASQYSVTFLSVAWYRQAPGKKRELVAGISDDGSNVYIDSVKGRFTISRDNAKNSVYLQMNSLRAEDTAVYYCYAYSWIDSLRYWGQGTLVTVSS

SEQ ID NO: 442 - protein, 117 aa, Artificial Sequence
  Description of Artificial Sequence: Synthetic polypeptide
EVQLVESGGGLVQPGGSLTLSCAASGETVSFLSLAWYRQAPGKKRELVAGISTDGSTVYFVSVKGRFTISRDNAKNSVYLQMNSLRAEDTAVYYCYAYSWTTPRAYWGQGTLVTVSS

SEQ ID NO: 443 - protein, 10 aa, Artificial Sequence
  Description of Artificial Sequence: Synthetic peptide
GSIFSIASMG

SEQ ID NO: 444 - protein, 10 aa, Artificial Sequence
  Description of Artificial Sequence: Synthetic peptide
GSIFSIASMG

SEQ ID NO: 445 - protein, 10 aa, Artificial Sequence
  Description of Artificial Sequence: Synthetic peptide
GSIFSIASMA

SEQ ID NO: 446 - protein, 10 aa, Artificial Sequence
  Description of Artificial Sequence: Synthetic peptide
ESIFSINVMA

SEQ ID NO: 447 - protein, 10 aa, Artificial Sequence
  Description of Artificial Sequence: Synthetic peptide
GSSFSITSMA

SEQ ID NO: 448 - protein, 10 aa, Artificial Sequence
  Description of Artificial Sequence: Synthetic peptide
SSIFSISSMS

SEQ ID NO: 449 - protein, 10 aa, Artificial Sequence
  Description of Artificial Sequence: Synthetic peptide
SSIFSISSMS

SEQ ID NO: 450 - protein, 10 aa, Artificial Sequence
  Description of Artificial Sequence: Synthetic peptide
GSTLNIKIMA

SEQ ID NO: 451 - protein, 10 aa, Artificial Sequence
  Description of Artificial Sequence: Synthetic peptide
GSTLNIKIMA

SEQ ID NO: 452 - protein, 10 aa, Artificial Sequence
  Description of Artificial Sequence: Synthetic peptide
GSTFNIKTMA

SEQ ID NO: 453 - protein, 10 aa, Artificial Sequence
  Description of Artificial Sequence: Synthetic peptide
GSTFNIKLMA

SEQ ID NO: 454 - protein, 10 aa, Artificial Sequence
  Description of Artificial Sequence: Synthetic peptide
GSTFNFKIMA

SEQ ID NO: 455 - protein, 10 aa, Artificial Sequence
  Description of Artificial Sequence: Synthetic peptide
GFMFSSYSMS

SEQ ID NO: 456 - protein, 10 aa, Artificial Sequence
  Description of Artificial Sequence: Synthetic peptide
GFMFSSYSMS

SEQ ID NO: 457 - protein, 10 aa, Artificial Sequence
  Description of Artificial Sequence: Synthetic peptide
GFTFSSHSMS

SEQ ID NO: 458 - protein, 10 aa, Artificial Sequence
  Description of Artificial Sequence: Synthetic peptide
GSSFSHNTMG

SEQ ID NO: 459 - protein, 10 aa, Artificial Sequence
  Description of Artificial Sequence: Synthetic peptide
GGRFSYATMG

SEQ ID NO: 460 - protein, 10 aa, Artificial Sequence
  Description of Artificial Sequence: Synthetic peptide
GSRFSYATMG

SEQ ID NO: 461 - protein, 10 aa, Artificial Sequence
  Description of Artificial Sequence: Synthetic peptide
GSTFTSNVMG

SEQ ID NO: 462 - protein, 10 aa, Artificial Sequence
  Description of Artificial Sequence: Synthetic peptide
GSSVSFLSMA

SEQ ID NO: 463 - protein, 10 aa, Artificial Sequence
  Description of Artificial Sequence: Synthetic peptide
GSSVSFLSMA

SEQ ID NO: 464 - protein, 10 aa, Artificial Sequence
  Description of Artificial Sequence: Synthetic peptide
GSSVSFLSMA

SEQ ID NO: 465 - protein, 10 aa, Artificial Sequence
  Description of Artificial Sequence: Synthetic peptide
GSSVSFLSMA

SEQ ID NO: 466 - protein, 10 aa, Artificial Sequence
  Description of Artificial Sequence: Synthetic peptide
GSSVSFLSMA

SEQ ID NO: 467 - protein, 10 aa, Artificial Sequence
  Description of Artificial Sequence: Synthetic peptide
GSSVSFLSMA

SEQ ID NO: 468 - protein, 10 aa, Artificial Sequence
  Description of Artificial Sequence: Synthetic peptide
GSSVSFLSMA

SEQ ID NO: 469 - protein, 10 aa, Artificial Sequence
  Description of Artificial Sequence: Synthetic peptide
GSSVSFLSIA

SEQ ID NO: 470 - protein, 10 aa, Artificial Sequence
  Description of Artificial Sequence: Synthetic peptide
GSSVSFLSMA

SEQ ID NO: 471 - protein, 10 aa, Artificial Sequence
  Description of Artificial Sequence: Synthetic peptide
GSSVSFLSMA

SEQ ID NO: 472 - protein, 10 aa, Artificial Sequence
  Description of Artificial Sequence: Synthetic peptide
GSSVSFLSMA

SEQ ID NO: 473 - protein, 10 aa, Artificial Sequence
  Description of Artificial Sequence: Synthetic peptide
GSSVSFLSMA

SEQ ID NO: 474 - protein, 10 aa, Artificial Sequence
  Description of Artificial Sequence: Synthetic peptide
GSSVSFLSMA

SEQ ID NO: 475 - protein, 10 aa, Artificial Sequence
  Description of Artificial Sequence: Synthetic peptide
GSSVSFLSMA

SEQ ID NO: 476 - protein, 10 aa, Artificial Sequence
  Description of Artificial Sequence: Synthetic peptide
GFTLDYYAIG

SEQ ID NO: 477 - protein, 10 aa, Artificial Sequence
  Description of Artificial Sequence: Synthetic peptide
GSTSSINAMG

SEQ ID NO: 478 - protein, 10 aa, Artificial Sequence
  Description of Artificial Sequence: Synthetic peptide
GSTSSINAMG

SEQ ID NO: 479 - protein, 10 aa, Artificial Sequence
  Description of Artificial Sequence: Synthetic peptide
GITSSVYSMG

SEQ ID NO: 480 - protein, 10 aa, Artificial Sequence
  Description of Artificial Sequence: Synthetic peptide
GRTSMFNSMG

SEQ ID NO: 481 - protein, 10 aa, Artificial Sequence
  Description of Artificial Sequence: Synthetic peptide
GRTSMVNSMG

SEQ ID NO: 482 - protein, 10 aa, Artificial Sequence
  Description of Artificial Sequence: Synthetic peptide
GSVSMFNSMG

SEQ ID NO: 483 - protein, 10 aa, Artificial Sequence
  Description of Artificial Sequence: Synthetic peptide
GSIFSIAVMG

SEQ ID NO: 484 - protein, 10 aa, Artificial Sequence
  Description of Artificial Sequence: Synthetic peptide
SGIFSDMSMV

SEQ ID NO: 485 - protein, 10 aa, Artificial Sequence
  Description of Artificial Sequence: Synthetic peptide
GSISSIIVMG

SEQ ID NO: 486 - protein, 10 aa, Artificial Sequence
  Description of Artificial Sequence: Synthetic peptide
GSISSIIVMG

SEQ ID NO: 487 - protein, 10 aa, Artificial Sequence
  Description of Artificial Sequence: Synthetic peptide
GSIFTTNSMG

SEQ ID NO: 488 - protein, 9 aa, Artificial Sequence
  Description of Artificial Sequence: Synthetic peptide
GSREISTMG

SEQ ID NO: 489 - protein, 9 aa, Artificial Sequence
  Description of Artificial Sequence: Synthetic peptide
GSREISTMG

SEQ ID NO: 490 - protein, 9 aa, Artificial Sequence
  Description of Artificial Sequence: Synthetic peptide
GSREISTMG

SEQ ID NO: 491 - protein, 9 aa, Artificial Sequence
  Description of Artificial Sequence: Synthetic peptide
GSREISTMG

SEQ ID NO: 492 - protein, 10 aa, Artificial Sequence
  Description of Artificial Sequence: Synthetic peptide
GSIFRGAAMY

SEQ ID NO: 493 - protein, 10 aa, Artificial Sequence
  Description of Artificial Sequence: Synthetic peptide
GSISSFNFMS

SEQ ID NO: 494 - protein, 10 aa, Artificial Sequence
  Description of Artificial Sequence: Synthetic peptide
GTIFTASTMG

SEQ ID NO: 495 - protein, 10 aa, Artificial Sequence
  Description of Artificial Sequence: Synthetic peptide
GSIFSIASMG

SEQ ID NO: 496 - protein, 10 aa, Artificial Sequence
  Description of Artificial Sequence: Synthetic peptide
GRTSMFNSMG

SEQ ID NO: 497 - protein, 10 aa, Artificial Sequence
  Description of Artificial Sequence: Synthetic peptide
GSSVSFLSMA

SEQ ID NO: 498 - protein, 10 aa, Artificial Sequence
  Description of Artificial Sequence: Synthetic peptide
GSIFRGAAMY

SEQ ID NO: 499 - protein, 10 aa, Artificial Sequence
  Description of Artificial Sequence: Synthetic peptide
GSTFNIKTMA

SEQ ID NO: 500 - protein, 10 aa, Artificial Sequence
  Description of Artificial Sequence: Synthetic peptide
GSTLNIKIMA

SEQ ID NO: 501 - protein, 10 aa, Artificial Sequence
  Description of Artificial Sequence: Synthetic peptide
SSIFSISSMS

SEQ ID NO: 502 - protein, 10 aa, Artificial Sequence
  Description of Artificial Sequence: Synthetic peptide
GSTSSINAMG

SEQ ID NO: 503 - protein, 10 aa, Artificial Sequence
  Description of Artificial Sequence: Synthetic peptide
GFMFSSYSMS

SEQ ID NO: 504 - protein, 10 aa, Artificial Sequence
  Description of Artificial Sequence: Synthetic peptide
GSVSMFNSMG

SEQ ID NO: 505 - protein, 10 aa, Artificial Sequence
  Description of Artificial Sequence: Synthetic peptide
GGRFSYATMG

SEQ ID NO: 506 - protein, 10 aa, Artificial Sequence
  Description of Artificial Sequence: Synthetic peptide
GSISSFNFMS

SEQ ID NO: 507 - protein, 10 aa, Artificial Sequence
  Description of Artificial Sequence: Synthetic peptide
ESIFSINVMA

SEQ ID NO: 508 - protein, 9 aa, Artificial Sequence
  Description of Artificial Sequence: Synthetic peptide
GSREISTMG

SEQ ID NO: 509 - protein, 10 aa, Artificial Sequence
  Description of Artificial Sequence: Synthetic peptide
GSIFSIAVMG

SEQ ID NO: 510 - protein, 10 aa, Artificial Sequence
  Description of Artificial Sequence: Synthetic peptide
GSTSSINAMG

SEQ ID NO: 511 - protein, 10 aa, Artificial Sequence
  Description of Artificial Sequence: Synthetic peptide
SGIFSDMSMV

SEQ ID NO: 512 - protein, 10 aa, Artificial Sequence
  Description of Artificial Sequence: Synthetic peptide
GFMFSSYSMS

SEQ ID NO: 513 - protein, 10 aa, Artificial Sequence
  Description of Artificial Sequence: Synthetic peptide
GSRFSYATMG

SEQ ID NO: 514 - protein, 10 aa, Artificial Sequence
  Description of Artificial Sequence: Synthetic peptide
GSTFTSNVMG

SEQ ID NO: 515 - protein, 10 aa, Artificial Sequence
  Description of Artificial Sequence: Synthetic peptide
GSSVSFLSMA

SEQ ID NO: 516 - protein, 10 aa, Artificial Sequence
  Description of Artificial Sequence: Synthetic peptide
GSISSIIVMG

SEQ ID NO: 517 - protein, 10 aa, Artificial Sequence
  Description of Artificial Sequence: Synthetic peptide
GSSVSFLSMA

SEQ ID NO: 518 - protein, 10 aa, Artificial Sequence
  Description of Artificial Sequence: Synthetic peptide
GTIFTASTMG

SEQ ID NO: 519 - protein, 10 aa, Artificial Sequence
  Description of Artificial Sequence: Synthetic peptide
GSSVSFLSMA

SEQ ID NO: 520 - protein, 10 aa, Artificial Sequence
  Description of Artificial Sequence: Synthetic peptide
GSSFSHNTMG

SEQ ID NO: 521 - protein, 10 aa, Artificial Sequence
  Description of Artificial Sequence: Synthetic peptide
GSISSIIVMG

SEQ ID NO: 522 - protein, 10 aa, Artificial Sequence
  Description of Artificial Sequence: Synthetic peptide
GSSFSITSMA

SEQ ID NO: 523 - protein, 10 aa, Artificial Sequence
  Description of Artificial Sequence: Synthetic peptide
GRTSMVNSMG

SEQ ID NO: 524 - protein, 10 aa, Artificial Sequence
  Description of Artificial Sequence: Synthetic peptide
GSTFNFKIMA

SEQ ID NO: 525 - protein, 10 aa, Artificial Sequence
  Description of Artificial Sequence: Synthetic peptide
GFTLDYYAIG

SEQ ID NO: 526 - protein, 10 aa, Artificial Sequence
  Description of Artificial Sequence: Synthetic peptide
GSIFTTNSMG

SEQ ID NO: 527 - protein, 10 aa, Artificial Sequence
  Description of Artificial Sequence: Synthetic peptide
GITSSVYSMG

SEQ ID NO: 528 - protein, 10 aa, Artificial Sequence
  Description of Artificial Sequence: Synthetic peptide
SSIFSISSMS

SEQ ID NO: 529 - protein, 10 aa, Artificial Sequence
  Description of Artificial Sequence: Synthetic peptide
GFTSSINAMG

SEQ ID NO: 530 - protein, 10 aa, Artificial Sequence
  Description of Artificial Sequence: Synthetic peptide
GSTSSINAMA

SEQ ID NO: 531 - protein, 10 aa, Artificial Sequence
  Description of Artificial Sequence: Synthetic peptide
GSTSSINAMG

SEQ ID NO: 532 - protein, 10 aa, Artificial Sequence
  Description of Artificial Sequence: Synthetic peptide
GSPSSINAMG

SEQ ID NO: 533 - protein, 10 aa, Artificial Sequence
  Description of Artificial Sequence: Synthetic peptide
GSTSSINAMG

SEQ ID NO: 534 - protein, 10 aa, Artificial Sequence
  Description of Artificial Sequence: Synthetic peptide
GSISSINAMG

SEQ ID NO: 535 - protein, 10 aa, Artificial Sequence
  Description of Artificial Sequence: Synthetic peptide
GSTSSINAMA

SEQ ID NO: 536 - protein, 10 aa, Artificial Sequence
  Description of Artificial Sequence: Synthetic peptide
GSTSSINAYG

SEQ ID NO: 537 - protein, 10 aa, Artificial Sequence
  Description of Artificial Sequence: Synthetic peptide
GSTSSINAIG

SEQ ID NO: 538 - protein, 10 aa, Artificial Sequence
  Description of Artificial Sequence: Synthetic peptide
GSTSSINAMA

SEQ ID NO: 539 - protein, 10 aa, Artificial Sequence
  Description of Artificial Sequence: Synthetic peptide
GSTSIINAMG

SEQ ID NO: 540 - protein, 10 aa, Artificial Sequence
  Description of Artificial Sequence: Synthetic peptide
GSTSSINAMG

SEQ ID NO: 541 - protein, 10 aa, Artificial Sequence
  Description of Artificial Sequence: Synthetic peptide
GKTSSINAMA

SEQ ID NO: 542 - protein, 10 aa, Artificial Sequence
  Description of Artificial Sequence: Synthetic peptide
GTTSSINAMG

SEQ ID NO: 543 - protein, 10 aa, Artificial Sequence
  Description of Artificial Sequence: Synthetic peptide
GSTSSINAMA

SEQ ID NO: 544 - protein, 10 aa, Artificial Sequence
  Description of Artificial Sequence: Synthetic peptide
GSGSSINAMG

SEQ ID NO: 545 - protein, 10 aa, Artificial Sequence
  Description of Artificial Sequence: Synthetic peptide
GTTSSINAMG

SEQ ID NO: 546 - protein, 10 aa, Artificial Sequence
  Description of Artificial Sequence: Synthetic peptide
GSTSSINAMA

SEQ ID NO: 547 - protein, 10 aa, Artificial Sequence
  Description of Artificial Sequence: Synthetic peptide
GSTSRINAMG

SEQ ID NO: 548 - protein, 10 aa, Artificial Sequence
  Description of Artificial Sequence: Synthetic peptide
GSTSRINAMG

SEQ ID NO: 549 - protein, 10 aa, Artificial Sequence
  Description of Artificial Sequence: Synthetic peptide
GSTSSINAMG

SEQ ID NO: 550 - protein, 10 aa, Artificial Sequence
  Description of Artificial Sequence: Synthetic peptide
GSTSSINAMA

SEQ ID NO: 551 - protein, 10 aa, Artificial Sequence
  Description of Artificial Sequence: Synthetic peptide
GSTSSINAMA

SEQ ID NO: 552 - protein, 10 aa, Artificial Sequence
  Description of Artificial Sequence: Synthetic peptide
GNTSSINAMA

SEQ ID NO: 553 - protein, 10 aa, Artificial Sequence
  Description of Artificial Sequence: Synthetic peptide
GSTSSINAMA

SEQ ID NO: 554 - protein, 10 aa, Artificial Sequence
  Description of Artificial Sequence: Synthetic peptide
GSTSIINAMG

SEQ ID NO: 555 - protein, 10 aa, Artificial Sequence
  Description of Artificial Sequence: Synthetic peptide
GSTSSINAMA

SEQ ID NO: 556 - protein, 10 aa, Artificial Sequence
  Description of Artificial Sequence: Synthetic peptide
GSTSRINAMG

SEQ ID NO: 557 - protein, 10 aa, Artificial Sequence
  Description of Artificial Sequence: Synthetic peptide
GSTSRINAMG

SEQ ID NO: 558 - protein, 10 aa, Artificial Sequence
  Description of Artificial Sequence: Synthetic peptide
GTTSSINAMG

SEQ ID NO: 559 - protein, 10 aa, Artificial Sequence
  Description of Artificial Sequence: Synthetic peptide
GITSSINAMG

SEQ ID NO: 560 - protein, 10 aa, Artificial Sequence
  Description of Artificial Sequence: Synthetic peptide
GSTSDINAMG

SEQ ID NO: 561 - protein, 10 aa, Artificial Sequence
  Description of Artificial Sequence: Synthetic peptide
GSTSSINAMA

SEQ ID NO: 562 - protein, 10 aa, Artificial Sequence
  Description of Artificial Sequence: Synthetic peptide
GSTSSINAIG

SEQ ID NO: 563 - protein, 10 aa, Artificial Sequence
  Description of Artificial Sequence: Synthetic peptide
GSTSSKNAMG

SEQ ID NO: 564 - protein, 10 aa, Artificial Sequence
  Description of Artificial Sequence: Synthetic peptide
GSTSSINAMG

SEQ ID NO: 565 - protein, 10 aa, Artificial Sequence
  Description of Artificial Sequence: Synthetic peptide
GLTSSINAMG

SEQ ID NO: 566 - protein, 10 aa, Artificial Sequence
  Description of Artificial Sequence: Synthetic peptide
GSTSSINAMA

SEQ ID NO: 567 - protein, 10 aa, Artificial Sequence
  Description of Artificial Sequence: Synthetic peptide
GSTSSNNAMA

SEQ ID NO: 568 - protein, 10 aa, Artificial Sequence
  Description of Artificial Sequence: Synthetic peptide
GSTSSINAMA

SEQ ID NO: 569 - protein, 10 aa, Artificial Sequence
  Description of Artificial Sequence: Synthetic peptide
GSTSHINAMG

SEQ ID NO: 570 - protein, 10 aa, Artificial Sequence
  Description of Artificial Sequence: Synthetic peptide
GQTSSINAMG

SEQ ID NO: 571 - protein, 10 aa, Artificial Sequence
  Description of Artificial Sequence: Synthetic peptide
GSTSRINGMG

SEQ ID NO: 572 - protein, 10 aa, Artificial Sequence
  Description of Artificial Sequence: Synthetic peptide
GSTSVINAMA

SEQ ID NO: 573 - protein, 10 aa, Artificial Sequence
  Description of Artificial Sequence: Synthetic peptide
GSTSSINAMA

SEQ ID NO: 574 - protein, 10 aa, Artificial Sequence
  Description of Artificial Sequence: Synthetic peptide
GKTSSINAMG

SEQ ID NO: 575 - protein, 10 aa, Artificial Sequence
  Description of Artificial Sequence: Synthetic peptide
GSTSSINAMA

SEQ ID NO: 576 - protein, 10 aa, Artificial Sequence
  Description of Artificial Sequence: Synthetic peptide
GSVSSINAMG

SEQ ID NO: 577 - protein, 10 aa, Artificial Sequence
  Description of Artificial Sequence: Synthetic peptide
GNTSSINAMG

SEQ ID NO: 578 - protein, 10 aa, Artificial Sequence
  Description of Artificial Sequence: Synthetic peptide
GSTSSTNAMG

SEQ ID NO: 579 - protein, 10 aa, Artificial Sequence
  Description of Artificial Sequence: Synthetic peptide
GSTSSINAMG

SEQ ID NO: 580 - protein, 10 aa, Artificial Sequence
  Description of Artificial Sequence: Synthetic peptide
GSTSSINAMA

SEQ ID NO: 581 - protein, 10 aa, Artificial Sequence
  Description of Artificial Sequence: Synthetic peptide
GGTSSINAMG

SEQ ID NO: 582 - protein, 10 aa, Artificial Sequence
  Description of Artificial Sequence: Synthetic peptide
GSTRSINAMG

SEQ ID NO: 583 - protein, 10 aa, Artificial Sequence
  Description of Artificial Sequence: Synthetic peptide
GTTSSINAMG

SEQ ID NO: 584 - protein, 10 aa, Artificial Sequence
  Description of Artificial Sequence: Synthetic peptide
GSTSSINAMG

SEQ ID NO: 585 - protein, 10 aa, Artificial Sequence
  Description of Artificial Sequence: Synthetic peptide
GSTSSINAMA

SEQ ID NO: 586 - protein, 10 aa, Artificial Sequence
  Description of Artificial Sequence: Synthetic peptide
GNTSSINAMG

SEQ ID NO: 587 - protein, 10 aa, Artificial Sequence
  Description of Artificial Sequence: Synthetic peptide
GSTSRINAMG

SEQ ID NO: 588 - protein, 10 aa, Artificial Sequence
  Description of Artificial Sequence: Synthetic peptide
GSTSSINAIG

SEQ ID NO: 589 - protein, 10 aa, Artificial Sequence
  Description of Artificial Sequence: Synthetic peptide
GLTSSINAMG

SEQ ID NO: 590 - protein, 10 aa, Artificial Sequence
  Description of Artificial Sequence: Synthetic peptide
GSTSSINAMA

SEQ ID NO: 591 - protein, 10 aa, Artificial Sequence
  Description of Artificial Sequence: Synthetic peptide
GSTSSTNAMG

SEQ ID NO: 592 - protein, 10 aa, Artificial Sequence
  Description of Artificial Sequence: Synthetic peptide
GSTSSINAIG

SEQ ID NO: 593 - protein, 10 aa, Artificial Sequence
  Description of Artificial Sequence: Synthetic peptide
GSTSSINAIG

SEQ ID NO: 594 - protein, 10 aa, Artificial Sequence
  Description of Artificial Sequence: Synthetic peptide
GSTSSINAMG

SEQ ID NO: 595 - protein, 10 aa, Artificial Sequence
  Description of Artificial Sequence: Synthetic peptide
GSTSSINAMG

SEQ ID NO: 596 - protein, 10 aa, Artificial Sequence
  Description of Artificial Sequence: Synthetic peptide
GSTSSINAMA

SEQ ID NO: 597 - protein, 10 aa, Artificial Sequence
  Description of Artificial Sequence: Synthetic peptide
GSTSSINAMA

SEQ ID NO: 598 - protein, 10 aa, Artificial Sequence
  Description of Artificial Sequence: Synthetic peptide
GSKSSINAMG

SEQ ID NO: 599 - protein, 10 aa, Artificial Sequence
  Description of Artificial Sequence: Synthetic peptide
GTTSSINAMG

SEQ ID NO: 600 - protein, 10 aa, Artificial Sequence
  Description of Artificial Sequence: Synthetic peptide
GSTSSINAFG

SEQ ID NO: 601 - protein, 10 aa, Artificial Sequence
  Description of Artificial Sequence: Synthetic peptide
GSTFSINAMG

SEQ ID NO: 602 - protein, 10 aa, Artificial Sequence
  Description of Artificial Sequence: Synthetic peptide
GSTRSINAMG

SEQ ID NO: 603 - protein, 10 aa, Artificial Sequence
  Description of Artificial Sequence: Synthetic peptide
GSTSSINAIG

SEQ ID NO: 604 - protein, 10 aa, Artificial Sequence
  Description of Artificial Sequence: Synthetic peptide
GSTSSINAMG

SEQ ID NO: 605 - protein, 10 aa, Artificial Sequence
  Description of Artificial Sequence: Synthetic peptide
GSTSSINAMG

SEQ ID NO: 606 - protein, 10 aa, Artificial Sequence
  Description of Artificial Sequence: Synthetic peptide
GTTSSINAMG

SEQ ID NO: 607 - protein, 10 aa, Artificial Sequence
  Description of Artificial Sequence: Synthetic peptide
GSTSSINAMA

SEQ ID NO: 608 - protein, 10 aa, Artificial Sequence
  Description of Artificial Sequence: Synthetic peptide
GRTSSINAMG

SEQ ID NO: 609 - protein, 10 aa, Artificial Sequence
  Description of Artificial Sequence: Synthetic peptide
GSTSSRNAMG

SEQ ID NO: 610 - protein, 10 aa, Artificial Sequence
  Description of Artificial Sequence: Synthetic peptide
GSTKSINAMG

SEQ ID NO: 611 - protein, 10 aa, Artificial Sequence
  Description of Artificial Sequence: Synthetic peptide
GSTSSRNAMG

SEQ ID NO: 612 - protein, 10 aa, Artificial Sequence
  Description of Artificial Sequence: Synthetic peptide
GSTSSINAIG

SEQ ID NO: 613 - protein, 10 aa, Artificial Sequence
  Description of Artificial Sequence: Synthetic peptide
GSTSLINAMG

SEQ ID NO: 614 - protein, 10 aa, Artificial Sequence
  Description of Artificial Sequence: Synthetic peptide
GSTSSINAMA

SEQ ID NO: 615 - protein, 10 aa, Artificial Sequence
  Description of Artificial Sequence: Synthetic peptide
GSTSSINAMG

SEQ ID NO: 616 - protein, 10 aa, Artificial Sequence
  Description of Artificial Sequence: Synthetic peptide
GTTSSINAMG

SEQ ID NO: 617 - protein, 10 aa, Artificial Sequence
  Description of Artificial Sequence: Synthetic peptide
GSTSSINAFG

SEQ ID NO: 618 - protein, 10 aa, Artificial Sequence
  Description of Artificial Sequence: Synthetic peptide
GSTSSRNAMG

SEQ ID NO: 619 - protein, 10 aa, Artificial Sequence
  Description of Artificial Sequence: Synthetic peptide
GNTSSINAMG

SEQ ID NO: 620 - protein, 10 aa, Artificial Sequence
  Description of Artificial Sequence: Synthetic peptide
GTTSSINAMG

SEQ ID NO: 621 - protein, 10 aa, Artificial Sequence
  Description of Artificial Sequence: Synthetic peptide
GSTASINAMG

SEQ ID NO: 622 - protein, 10 aa, Artificial Sequence
  Description of Artificial Sequence: Synthetic peptide
GSTSSINAVG

SEQ ID NO: 623 - protein, 10 aa, Artificial Sequence
  Description of Artificial Sequence: Synthetic peptide
GSTSSRNAMG

SEQ ID NO: 624 - protein, 10 aa, Artificial Sequence
  Description of Artificial Sequence: Synthetic peptide
GSTNSINAMG

SEQ ID NO: 625 - protein, 10 aa, Artificial Sequence
  Description of Artificial Sequence: Synthetic peptide
GSTSSINAMA

SEQ ID NO: 626 - protein, 10 aa, Artificial Sequence
  Description of Artificial Sequence: Synthetic peptide
GSTSRINAMG

SEQ ID NO: 627 - protein, 10 aa, Artificial Sequence
  Description of Artificial Sequence: Synthetic peptide
GSTSNINAMG

SEQ ID NO: 628 - protein, 10 aa, Artificial Sequence
  Description of Artificial Sequence: Synthetic peptide
GSTSKINAMG

SEQ ID NO: 629 - protein, 10 aa, Artificial Sequence
  Description of Artificial Sequence: Synthetic peptide
GSTSSINALG

SEQ ID NO: 630 - protein, 10 aa, Artificial Sequence
  Description of Artificial Sequence: Synthetic peptide
GKTSSINAMG

SEQ ID NO: 631 - protein, 10 aa, Artificial Sequence
  Description of Artificial Sequence: Synthetic peptide
GSTSSINAVG

SEQ ID NO: 632 - protein, 10 aa, Artificial Sequence
  Description of Artificial Sequence: Synthetic peptide
GSTSRINAMG

SEQ ID NO: 633 - protein, 10 aa, Artificial Sequence
  Description of Artificial Sequence: Synthetic peptide
GSTSSINAMG

SEQ ID NO: 634 - protein, 10 aa, Artificial Sequence
  Description of Artificial Sequence: Synthetic peptide
GSTSSINAVG

SEQ ID NO: 635 - protein, 10 aa, Artificial Sequence
  Description of Artificial Sequence: Synthetic peptide
GTTSSINAMG

SEQ ID NO: 636 - protein, 10 aa, Artificial Sequence
  Description of Artificial Sequence: Synthetic peptide
GSTSSINAMG

SEQ ID NO: 637 - protein, 10 aa, Artificial Sequence
  Description of Artificial Sequence: Synthetic peptide
GTTSSINAMG

SEQ ID NO: 638 - protein, 10 aa, Artificial Sequence
  Description of Artificial Sequence: Synthetic peptide
GKTSSINAMG

SEQ ID NO: 639 - protein, 10 aa, Artificial Sequence
  Description of Artificial Sequence: Synthetic peptide
GSTSSINAMG

SEQ ID NO: 640 - protein, 10 aa, Artificial Sequence
  Description of Artificial Sequence: Synthetic peptide
GSTSAINAMG

SEQ ID NO: 641 - protein, 10 aa, Artificial Sequence
  Description of Artificial Sequence: Synthetic peptide
GSPSSINAYG

SEQ ID NO: 642 - protein, 10 aa, Artificial Sequence
  Description of Artificial Sequence: Synthetic peptide
GSTSSINAMG

SEQ ID NO: 643 - protein, 10 aa, Artificial Sequence
  Description of Artificial Sequence: Synthetic peptide
GSRSSINAMG

SEQ ID NO: 644 - protein, 10 aa, Artificial Sequence
  Description of Artificial Sequence: Synthetic peptide
GSVSSINAMG

SEQ ID NO: 645 - protein, 10 aa, Artificial Sequence
  Description of Artificial Sequence: Synthetic peptide
GSTSSINAMA

SEQ ID NO: 646 - protein, 10 aa, Artificial Sequence
  Description of Artificial Sequence: Synthetic peptide
GSTSSINAIG

SEQ ID NO: 647 - protein, 10 aa, Artificial Sequence
  Description of Artificial Sequence: Synthetic peptide
GSTSSINAMG

SEQ ID NO: 648 - protein, 10 aa, Artificial Sequence
  Description of Artificial Sequence: Synthetic peptide
GSTSSINAVG

SEQ ID NO: 649 - protein, 10 aa, Artificial Sequence
  Description of Artificial Sequence: Synthetic peptide
GSTSSINAMA

SEQ ID NO: 650 - protein, 10 aa, Artificial Sequence
  Description of Artificial Sequence: Synthetic peptide
GSTSSINAYG

SEQ ID NO: 651 - protein, 10 aa, Artificial Sequence
  Description of Artificial Sequence: Synthetic peptide
GSTSSINAVG

SEQ ID NO: 652 - protein, 10 aa, Artificial Sequence
  Description of Artificial Sequence: Synthetic peptide
GSKSSINAMG

SEQ ID NO: 653 - protein, 10 aa, Artificial Sequence
  Description of Artificial Sequence: Synthetic peptide
GSTSSINAMA

SEQ ID NO: 654 - protein, 10 aa, Artificial Sequence
  Description of Artificial Sequence: Synthetic peptide
GSVSSINAMG

SEQ ID NO: 655 - protein, 10 aa, Artificial Sequence
  Description of Artificial Sequence: Synthetic peptide
GSTSSINAMG

SEQ ID NO: 656 - protein, 10 aa, Artificial Sequence
  Description of Artificial Sequence: Synthetic peptide
GSTSSINAMG

SEQ ID NO: 657 - protein, 10 aa, Artificial Sequence
  Description of Artificial Sequence: Synthetic peptide
GSTSSINAMA

SEQ ID NO: 658 - protein, 10 aa, Artificial Sequence
  Description of Artificial Sequence: Synthetic peptide
GSTSYINAMG

SEQ ID NO: 659 - protein, 10 aa, Artificial Sequence
  Description of Artificial Sequence: Synthetic peptide
GSTSSINAMG

SEQ ID NO: 660 - protein, 10 aa, Artificial Sequence
  Description of Artificial Sequence: Synthetic peptide
GSTSSINAMG

SEQ ID NO: 661 - protein, 10 aa, Artificial Sequence
  Description of Artificial Sequence: Synthetic peptide
GSTSSINAMG

SEQ ID NO: 662 - protein, 10 aa, Artificial Sequence
  Description of Artificial Sequence: Synthetic peptide
GSTSRINAMG

SEQ ID NO: 663 - protein, 10 aa, Artificial Sequence
  Description of Artificial Sequence: Synthetic peptide
GSTSSINAMA

SEQ ID NO: 664 - protein, 10 aa, Artificial Sequence
  Description of Artificial Sequence: Synthetic peptide
GSTSSINAMA

SEQ ID NO: 665 - protein, 10 aa, Artificial Sequence
  Description of Artificial Sequence: Synthetic peptide
GSTSSINAMG

SEQ ID NO: 666 - protein, 10 aa, Artificial Sequence
  Description of Artificial Sequence: Synthetic peptide
GSTSTINAMG

SEQ ID NO: 667 - protein, 10 aa, Artificial Sequence
  Description of Artificial Sequence: Synthetic peptide
GSTSSINAVG

SEQ ID NO: 668 - protein, 10 aa, Artificial Sequence
  Description of Artificial Sequence: Synthetic peptide
GSTSSINAMG

SEQ ID NO: 669 - protein, 10 aa, Artificial Sequence
  Description of Artificial Sequence: Synthetic peptide
GSPSSINAYG

SEQ ID NO: 670 - protein, 10 aa, Artificial Sequence
  Description of Artificial Sequence: Synthetic peptide
GSPSSINAYG

SEQ ID NO: 671 - protein, 10 aa, Artificial Sequence
  Description of Artificial Sequence: Synthetic peptide
GSSVKFLSMA

SEQ ID NO: 672 - protein, 10 aa, Artificial Sequence
  Description of Artificial Sequence: Synthetic peptide
GSSVSFLSLA

SEQ ID NO: 673 - protein, 10 aa, Artificial Sequence
  Description of Artificial Sequence: Synthetic peptide
GSRVSFLSMA

SEQ ID NO: 674 - protein, 10 aa, Artificial Sequence
  Description of Artificial Sequence: Synthetic peptide
GSQVSFLSMA

SEQ ID NO: 675 - protein, 10 aa, Artificial Sequence
  Description of Artificial Sequence: Synthetic peptide
GSSVSFLSMA

SEQ ID NO: 676 - protein, 10 aa, Artificial Sequence
  Description of Artificial Sequence: Synthetic peptide
GSKVSFLSMA

SEQ ID NO: 677 - protein, 10 aa, Artificial Sequence
  Description of Artificial Sequence: Synthetic peptide
GSSVGFLSMA

SEQ ID NO: 678 - protein, 10 aa, Artificial Sequence
  Description of Artificial Sequence: Synthetic peptide
GSSVSFLSMA

SEQ ID NO: 679 - protein, 10 aa, Artificial Sequence
  Description of Artificial Sequence: Synthetic peptide
GSRVSFLSMA

SEQ ID NO: 680 - protein, 10 aa, Artificial Sequence
  Description of Artificial Sequence: Synthetic peptide
GSSVSFLSLA

SEQ ID NO: 681 - protein, 10 aa, Artificial Sequence
  Description of Artificial Sequence: Synthetic peptide
GSSVSFLSMA

SEQ ID NO: 682 - protein, 10 aa, Artificial Sequence
  Description of Artificial Sequence: Synthetic peptide
GSSVQFLSMA

SEQ ID NO: 683 - protein, 10 aa, Artificial Sequence
  Description of Artificial Sequence: Synthetic peptide
GSNVSFLSMA

SEQ ID NO: 684 - protein, 10 aa, Artificial Sequence
  Description of Artificial Sequence: Synthetic peptide
GSSVKFLSMA

SEQ ID NO: 685 - protein, 10 aa, Artificial Sequence
  Description of Artificial Sequence: Synthetic peptide
GKSVSFLSMA

SEQ ID NO: 686 - protein, 10 aa, Artificial Sequence
  Description of Artificial Sequence: Synthetic peptide
GSRVSFLSMA

SEQ ID NO: 687 - protein, 10 aa, Artificial Sequence
  Description of Artificial Sequence: Synthetic peptide
GSHVSFLSMA

SEQ ID NO: 688 - protein, 10 aa, Artificial Sequence
  Description of Artificial Sequence: Synthetic peptide
GSSVSFLSMA

SEQ ID NO: 689 - protein, 10 aa, Artificial Sequence
  Description of Artificial Sequence: Synthetic peptide
GSSVSFLSMA

SEQ ID NO: 690 - protein, 10 aa, Artificial Sequence
  Description of Artificial Sequence: Synthetic peptide
GSSVRFLSMA

SEQ ID NO: 691 - protein, 10 aa, Artificial Sequence
  Description of Artificial Sequence: Synthetic peptide
GSSVRFLSMA

SEQ ID NO: 692 - protein, 10 aa, Artificial Sequence
  Description of Artificial Sequence: Synthetic peptide
GSSVRFLSMA

SEQ ID NO: 693 - protein, 10 aa, Artificial Sequence
  Description of Artificial Sequence: Synthetic peptide
GSHVSFLSMA

SEQ ID NO: 694 - protein, 10 aa, Artificial Sequence
  Description of Artificial Sequence: Synthetic peptide
GTSVSFLSMA

SEQ ID NO: 695 - protein, 10 aa, Artificial Sequence
  Description of Artificial Sequence: Synthetic peptide
GTSVSFLSIA

SEQ ID NO: 696 - protein, 10 aa, Artificial Sequence
  Description of Artificial Sequence: Synthetic peptide
GSSVKFLSMA

SEQ ID NO: 697 - protein, 10 aa, Artificial Sequence
  Description of Artificial Sequence: Synthetic peptide
GSSVSFLSMA

SEQ ID NO: 698 - protein, 10 aa, Artificial Sequence
  Description of Artificial Sequence: Synthetic peptide
GSSVRFLSMA

SEQ ID NO: 699 - protein, 10 aa, Artificial Sequence
  Description of Artificial Sequence: Synthetic peptide
GSSVSFLSMA

SEQ ID NO: 700 - protein, 10 aa, Artificial Sequence
  Description of Artificial Sequence: Synthetic peptide
GSSVRFLSMA

SEQ ID NO: 701 - protein, 10 aa, Artificial Sequence
  Description of Artificial Sequence: Synthetic peptide
GSSVVFLSMA

SEQ ID NO: 702 - protein, 10 aa, Artificial Sequence
  Description of Artificial Sequence: Synthetic peptide
GSSVRFLSMA

SEQ ID NO: 703 - protein, 10 aa, Artificial Sequence
  Description of Artificial Sequence: Synthetic peptide
GSSVRFLSMA

SEQ ID NO: 704 - protein, 10 aa, Artificial Sequence
  Description of Artificial Sequence: Synthetic peptide
GSSVRFLSMA

SEQ ID NO: 705 - protein, 10 aa, Artificial Sequence
  Description of Artificial Sequence: Synthetic peptide
GSSVSRLSMA

SEQ ID NO: 706 - protein, 10 aa, Artificial Sequence
  Description of Artificial Sequence: Synthetic peptide
GSSKSFLSMA

SEQ ID NO: 707 - protein, 10 aa, Artificial Sequence
  Description of Artificial Sequence: Synthetic peptide
GSSVSRLSMA

SEQ ID NO: 708 - protein, 10 aa, Artificial Sequence
  Description of Artificial Sequence: Synthetic peptide
GSSVKFLSMA

SEQ ID NO: 709 - protein, 10 aa, Artificial Sequence
  Description of Artificial Sequence: Synthetic peptide
GSGVRFLSMA

SEQ ID NO: 710 - protein, 10 aa, Artificial Sequence
  Description of Artificial Sequence: Synthetic peptide
GSSVRFLSMA

SEQ ID NO: 711 - protein, 10 aa, Artificial Sequence
  Description of Artificial Sequence: Synthetic peptide
GSSVHFLSMA

SEQ ID NO: 712 - protein, 10 aa, Artificial Sequence
  Description of Artificial Sequence: Synthetic peptide
GSSVRFLSMA

SEQ ID NO: 713 - protein, 10 aa, Artificial Sequence
  Description of Artificial Sequence: Synthetic peptide
GSKVSFLSMA

SEQ ID NO: 714 - protein, 10 aa, Artificial Sequence
  Description of Artificial Sequence: Synthetic peptide
GSSVSFLSMA

SEQ ID NO: 715 - protein, 10 aa, Artificial Sequence
  Description of Artificial Sequence: Synthetic peptide
GSKVSFLSMA

SEQ ID NO: 716 - protein, 10 aa, Artificial Sequence
  Description of Artificial Sequence: Synthetic peptide
GSRVSFLSMA

SEQ ID NO: 717 - protein, 10 aa, Artificial Sequence
  Description of Artificial Sequence: Synthetic peptide
GSRVSFLSMA

SEQ ID NO: 718 - protein, 10 aa, Artificial Sequence
  Description of Artificial Sequence: Synthetic peptide
GSSVRFLSMA

SEQ ID NO: 719 - protein, 10 aa, Artificial Sequence
  Description of Artificial Sequence: Synthetic peptide
YSSVSRLSMA

SEQ ID NO: 720 - protein, 10 aa, Artificial Sequence
  Description of Artificial Sequence: Synthetic peptide
GSSVSFLSMA

SEQ ID NO: 721 - protein, 10 aa, Artificial Sequence
  Description of Artificial Sequence: Synthetic peptide
GSSVSFLSMA

SEQ ID NO: 722 - protein, 10 aa, Artificial Sequence
  Description of Artificial Sequence: Synthetic peptide
GSSVSFLSMA

SEQ ID NO: 723 - protein, 10 aa, Artificial Sequence
  Description of Artificial Sequence: Synthetic peptide
GTSVSFLSMA

SEQ ID NO: 724 - protein, 10 aa, Artificial Sequence
  Description of Artificial Sequence: Synthetic peptide
GSSVKFLSMA

SEQ ID NO: 725 - protein, 10 aa, Artificial Sequence
  Description of Artificial Sequence: Synthetic peptide
GSSVSFLSMA

SEQ ID NO: 726 - protein, 10 aa, Artificial Sequence
  Description of Artificial Sequence: Synthetic peptide
GSRVSFLSMA

SEQ ID NO: 727 - protein, 10 aa, Artificial Sequence
  Description of Artificial Sequence: Synthetic peptide
GSSVSVLSMA

SEQ ID NO: 728 - protein, 10 aa, Artificial Sequence
  Description of Artificial Sequence: Synthetic peptide
GSSVSFLSMA

SEQ ID NO: 729 - protein, 10 aa, Artificial Sequence
  Description of Artificial Sequence: Synthetic peptide
GSRVSFLSMA

SEQ ID NO: 730 - protein, 10 aa, Artificial Sequence
  Description of Artificial Sequence: Synthetic peptide
GSSVKFLSMA

SEQ ID NO: 731 - protein, 10 aa, Artificial Sequence
  Description of Artificial Sequence: Synthetic peptide
GSSVRFLSMA

SEQ ID NO: 732 - protein, 10 aa, Artificial Sequence
  Description of Artificial Sequence: Synthetic peptide
GSSVSQLSMA

SEQ ID NO: 733 - protein, 10 aa, Artificial Sequence
  Description of Artificial Sequence: Synthetic peptide
GSRVSFLSMA

SEQ ID NO: 734 - protein, 10 aa, Artificial Sequence
  Description of Artificial Sequence: Synthetic peptide
KSSVSFLSMA

SEQ ID NO: 735 - protein, 10 aa, Artificial Sequence
  Description of Artificial Sequence: Synthetic peptide
GSSVSFLSMA

SEQ ID NO: 736 - protein, 10 aa, Artificial Sequence
  Description of Artificial Sequence: Synthetic peptide
GSSVKFLSMA

SEQ ID NO: 737 - protein, 10 aa, Artificial Sequence
  Description of Artificial Sequence: Synthetic peptide
GSSVRFLSMA

SEQ ID NO: 738 - protein, 10 aa, Artificial Sequence
  Description of Artificial Sequence: Synthetic peptide
GSSVRFLSMA

SEQ ID NO: 739 - protein, 10 aa, Artificial Sequence
  Description of Artificial Sequence: Synthetic peptide
GSRVSFLSMA

SEQ ID NO: 740 - protein, 10 aa, Artificial Sequence
  Description of Artificial Sequence: Synthetic peptide
GSSVSFLSLA

SEQ ID NO: 741 - protein, 10 aa, Artificial Sequence
  Description of Artificial Sequence: Synthetic peptide
GSSVRFLSMA

SEQ ID NO: 742 - protein, 10 aa, Artificial Sequence
  Description of Artificial Sequence: Synthetic peptide
GSKVSFLSMA

SEQ ID NO: 743 - protein, 10 aa, Artificial Sequence
  Description of Artificial Sequence: Synthetic peptide
GSSVSFLSMA

SEQ ID NO: 744 - protein, 10 aa, Artificial Sequence
  Description of Artificial Sequence: Synthetic peptide
GSSVRFLSMA

SEQ ID NO: 745 - protein, 10 aa, Artificial Sequence
  Description of Artificial Sequence: Synthetic peptide
GSKVSFLSMA

SEQ ID NO: 746 - protein, 10 aa, Artificial Sequence
  Description of Artificial Sequence: Synthetic peptide
GSSVKFLSMA

SEQ ID NO: 747 - protein, 10 aa, Artificial Sequence
  Description of Artificial Sequence: Synthetic peptide
GSSVKFLSMA

SEQ ID NO: 748 - protein, 10 aa, Artificial Sequence
  Description of Artificial Sequence: Synthetic peptide
GSRVSFLSMA

SEQ ID NO: 749 - protein, 10 aa, Artificial Sequence
  Description of Artificial Sequence: Synthetic peptide
GSSVLFLSMA

SEQ ID NO: 750 - protein, 10 aa, Artificial Sequence
  Description of Artificial Sequence: Synthetic peptide
GSRVSFLSMA

SEQ ID NO: 751 - protein, 10 aa, Artificial Sequence
  Description of Artificial Sequence: Synthetic peptide
GSRVSFLSMA

SEQ ID NO: 752 - protein, 10 aa, Artificial Sequence
  Description of Artificial Sequence: Synthetic peptide
GSSVGFLSMA

SEQ ID NO: 753 - protein, 10 aa, Artificial Sequence
  Description of Artificial Sequence: Synthetic peptide
GSSVSFMSMA

SEQ ID NO: 754 - protein, 10 aa, Artificial Sequence
  Description of Artificial Sequence: Synthetic peptide
GSSVSFLSMA

SEQ ID NO: 755 - protein, 10 aa, Artificial Sequence
  Description of Artificial Sequence: Synthetic peptide
GSSVTFLSMA

SEQ ID NO: 756 - protein, 10 aa, Artificial Sequence
  Description of Artificial Sequence: Synthetic peptide
GSSVRFLSMA

SEQ ID NO: 757 - protein, 10 aa, Artificial Sequence
  Description of Artificial Sequence: Synthetic peptide
GSKVSFLSMA

SEQ ID NO: 758 - protein, 10 aa, Artificial Sequence
  Description of Artificial Sequence: Synthetic peptide
GSKVSFMSMA

SEQ ID NO: 759 - protein, 10 aa, Artificial Sequence
  Description of Artificial Sequence: Synthetic peptide
GSSVSNLSMA

SEQ ID NO: 760 - protein, 10 aa, Artificial Sequence
  Description of Artificial Sequence: Synthetic peptide
NSSVSKLSMA

SEQ ID NO: 761 - protein, 10 aa, Artificial Sequence
  Description of Artificial Sequence: Synthetic peptide
GSKVSFLSMA

SEQ ID NO: 762 - protein, 10 aa, Artificial Sequence
  Description of Artificial Sequence: Synthetic peptide
GSQVSFLSMA

SEQ ID NO: 763 - protein, 10 aa, Artificial Sequence
  Description of Artificial Sequence: Synthetic peptide
GSKVSFMSMA

SEQ ID NO: 764 - protein, 10 aa, Artificial Sequence
  Description of Artificial Sequence: Synthetic peptide
GSRVSFLSMA

SEQ ID NO: 765 - protein, 10 aa, Artificial Sequence
  Description of Artificial Sequence: Synthetic peptide
GSSVRFLSMA

SEQ ID NO: 766 - protein, 10 aa, Artificial Sequence
  Description of Artificial Sequence: Synthetic peptide
GSKVSFLSMA

SEQ ID NO: 767 - protein, 10 aa, Artificial Sequence
  Description of Artificial Sequence: Synthetic peptide
GSSVRFLSMA

SEQ ID NO: 768 - protein, 10 aa, Artificial Sequence
  Description of Artificial Sequence: Synthetic peptide
GSSVSFLSIA

SEQ ID NO: 769 - protein, 10 aa, Artificial Sequence
  Description of Artificial Sequence: Synthetic peptide
GSSSSFLSMA

SEQ ID NO: 770 - protein, 10 aa, Artificial Sequence
  Description of Artificial Sequence: Synthetic peptide
GSSVKFLSMA

SEQ ID NO: 771 - protein, 10 aa, Artificial Sequence
  Description of Artificial Sequence: Synthetic peptide
GSSVNFLSMA

SEQ ID NO: 772 - protein, 10 aa, Artificial Sequence
  Description of Artificial Sequence: Synthetic peptide
GSSVKFLSMA

SEQ ID NO: 773 - protein, 10 aa, Artificial Sequence
  Description of Artificial Sequence: Synthetic peptide
GSSVSFLSMA

SEQ ID NO: 774 - protein, 10 aa, Artificial Sequence
  Description of Artificial Sequence: Synthetic peptide
GSSVRFLSMA

SEQ ID NO: 775 - protein, 10 aa, Artificial Sequence
  Description of Artificial Sequence: Synthetic peptide
GSSVSFLSVA

SEQ ID NO: 776 - protein, 10 aa, Artificial Sequence
  Description of Artificial Sequence: Synthetic peptide
GSQVSFLSMA

SEQ ID NO: 777 - protein, 10 aa, Artificial Sequence
  Description of Artificial Sequence: Synthetic peptide
GTSVSFLSMA

SEQ ID NO: 778 - protein, 10 aa, Artificial Sequence
  Description of Artificial Sequence: Synthetic peptide
GSRVSFLSMA

SEQ ID NO: 779 - protein, 10 aa, Artificial Sequence
  Description of Artificial Sequence: Synthetic peptide
GSSVKFLSMA

SEQ ID NO: 780 - protein, 10 aa, Artificial Sequence
  Description of Artificial Sequence: Synthetic peptide
GSSVSFLSSA

SEQ ID NO: 781 - protein, 10 aa, Artificial Sequence
  Description of Artificial Sequence: Synthetic peptide
GSSVKFLSMA

SEQ ID NO: 782 - protein, 10 aa, Artificial Sequence
  Description of Artificial Sequence: Synthetic peptide
GSSVSFLSMA

SEQ ID NO: 783 - protein, 10 aa, Artificial Sequence
  Description of Artificial Sequence: Synthetic peptide
GSTVSFLSMA

SEQ ID NO: 784 - protein, 10 aa, Artificial Sequence
  Description of Artificial Sequence: Synthetic peptide
GSSVQFLSMA

SEQ ID NO: 785 - protein, 10 aa, Artificial Sequence
  Description of Artificial Sequence: Synthetic peptide
RSSVSFLSMA

SEQ ID NO: 786 - protein, 10 aa, Artificial Sequence
  Description of Artificial Sequence: Synthetic peptide
GSKVSFLSMA

SEQ ID NO: 787 - protein, 10 aa, Artificial Sequence
  Description of Artificial Sequence: Synthetic peptide
GSRVSFLSMA

SEQ ID NO: 788 - protein, 10 aa, Artificial Sequence
  Description of Artificial Sequence: Synthetic peptide
GSSVSFLSMA

SEQ ID NO: 789 - protein, 10 aa, Artificial Sequence
  Description of Artificial Sequence: Synthetic peptide
GSKVSFLSMA

SEQ ID NO: 790 - protein, 10 aa, Artificial Sequence
  Description of Artificial Sequence: Synthetic peptide
GSSVRFLSMA

SEQ ID NO: 791 - protein, 10 aa, Artificial Sequence
  Description of Artificial Sequence: Synthetic peptide
GSSVKFLSMA

SEQ ID NO: 792 - protein, 10 aa, Artificial Sequence
  Description of Artificial Sequence: Synthetic peptide
GSSVKFLSMA

SEQ ID NO: 793 - protein, 10 aa, Artificial Sequence
  Description of Artificial Sequence: Synthetic peptide
GSSVSILSMA

SEQ ID NO: 794 - protein, 10 aa, Artificial Sequence
  Description of Artificial Sequence: Synthetic peptide
GSSVSFLSVA

SEQ ID NO: 795 - protein, 10 aa, Artificial Sequence
  Description of Artificial Sequence: Synthetic peptide
GSSVRFLSMA

SEQ ID NO: 796 - protein, 10 aa, Artificial Sequence
  Description of Artificial Sequence: Synthetic peptide
GSRVSFLSMA

SEQ ID NO: 797 - protein, 10 aa, Artificial Sequence
  Description of Artificial Sequence: Synthetic peptide
GHSVSFLSMA

SEQ ID NO: 798 - protein, 10 aa, Artificial Sequence
  Description of Artificial Sequence: Synthetic peptide
GSSVRFLSMA

SEQ ID NO: 799 - protein, 10 aa, Artificial Sequence
  Description of Artificial Sequence: Synthetic peptide
GSSVSFLSMA

SEQ ID NO: 800 - protein, 10 aa, Artificial Sequence
  Description of Artificial Sequence: Synthetic peptide
GSRVSFLSMA

SEQ ID NO: 801 - protein, 10 aa, Artificial Sequence
  Description of Artificial Sequence: Synthetic peptide
GSSVKFLSMA

SEQ ID NO: 802 - protein, 10 aa, Artificial Sequence
  Description of Artificial Sequence: Synthetic peptide
GSSVSRLSMA

SEQ ID NO: 803 - protein, 10 aa, Artificial Sequence
  Description of Artificial Sequence: Synthetic peptide
GRSVSFLSMA

SEQ ID NO: 804 - protein, 10 aa, Artificial Sequence
  Description of Artificial Sequence: Synthetic peptide
GRSVSFLSMA

SEQ ID NO: 805 - protein, 10 aa, Artificial Sequence
  Description of Artificial Sequence: Synthetic peptide
GSSVKFLSMA

SEQ ID NO: 806 - protein, 10 aa, Artificial Sequence
  Description of Artificial Sequence: Synthetic peptide
GSSVSKLSMA

SEQ ID NO: 807 - protein, 10 aa, Artificial Sequence
  Description of Artificial Sequence: Synthetic peptide
GSSVSRLSMA

SEQ ID NO: 808 - protein, 10 aa, Artificial Sequence
  Description of Artificial Sequence: Synthetic peptide
GSSVKFLSLA

SEQ ID NO: 809 - protein, 10 aa, Artificial Sequence
  Description of Artificial Sequence: Synthetic peptide
GSSVSRLSLA

SEQ ID NO: 810 - protein, 10 aa, Artificial Sequence
  Description of Artificial Sequence: Synthetic peptide
GTSSSINAMG

SEQ ID NO: 811 - protein, 10 aa, Artificial Sequence
  Description of Artificial Sequence: Synthetic peptide
GTTSSINAIG

SEQ ID NO: 812 - protein, 10 aa, Artificial Sequence
  Description of Artificial Sequence: Synthetic peptide
GSTSSINAMA

SEQ ID NO: 813 - protein, 10 aa, Artificial Sequence
  Description of Artificial Sequence: Synthetic peptide
GQTYRVNAFG

SEQ ID NO: 814 - protein, 10 aa, Artificial Sequence
  Description of Artificial Sequence: Synthetic peptide
GSTSSINAMA

SEQ ID NO: 815 - protein, 10 aa, Artificial Sequence
  Description of Artificial Sequence: Synthetic peptide
GSASLTNATG

SEQ ID NO: 816 - protein, 10 aa, Artificial Sequence
  Description of Artificial Sequence: Synthetic peptide
GYPSLNNAMG

SEQ ID NO: 817 - protein, 10 aa, Artificial Sequence
  Description of Artificial Sequence: Synthetic peptide
GSSSTINAIG

SEQ ID NO: 818 - protein, 10 aa, Artificial Sequence
  Description of Artificial Sequence: Synthetic peptide
GSTSYINAMG

SEQ ID NO: 819 - protein, 10 aa, Artificial Sequence
  Description of Artificial Sequence: Synthetic peptide
GSTSSVNALG

SEQ ID NO: 820 - protein, 10 aa, Artificial Sequence
  Description of Artificial Sequence: Synthetic peptide
GSTSLSNAVG

SEQ ID NO: 821 - protein, 10 aa, Artificial Sequence
  Description of Artificial Sequence: Synthetic peptide
GSTSSTNAIG

SEQ ID NO: 822 - protein, 10 aa, Artificial Sequence
  Description of Artificial Sequence: Synthetic peptide
GLTSTINAMG

SEQ ID NO: 823 - protein, 10 aa, Artificial Sequence
  Description of Artificial Sequence: Synthetic peptide
GVSPSKNAIG

SEQ ID NO: 824 - protein, 10 aa, Artificial Sequence
  Description of Artificial Sequence: Synthetic peptide
GSTSSINAVG

SEQ ID NO: 825 - protein, 10 aa, Artificial Sequence
  Description of Artificial Sequence: Synthetic peptide
GSTTMNNAMA

SEQ ID NO: 826 - protein, 10 aa, Artificial Sequence
  Description of Artificial Sequence: Synthetic peptide
GSTSKINAIG

SEQ ID NO: 827 - protein, 10 aa, Artificial Sequence
  Description of Artificial Sequence: Synthetic peptide
GQTTALNAMG

SEQ ID NO: 828 - protein, 10 aa, Artificial Sequence
  Description of Artificial Sequence: Synthetic peptide
GATSSINAIG

SEQ ID NO: 829 - protein, 10 aa, Artificial Sequence
  Description of Artificial Sequence: Synthetic peptide
GSTSTINAMG

SEQ ID NO: 830 - protein, 10 aa, Artificial Sequence
  Description of Artificial Sequence: Synthetic peptide
GSTSSINAMG

SEQ ID NO: 831 - protein, 10 aa, Artificial Sequence
  Description of Artificial Sequence: Synthetic peptide
GSTSLVNAMG

SEQ ID NO: 832 - protein, 10 aa, Artificial Sequence
  Description of Artificial Sequence: Synthetic peptide
GSTSLNNAIG

SEQ ID NO: 833 - protein, 10 aa, Artificial Sequence
  Description of Artificial Sequence: Synthetic peptide
GSTSPVNAMA

SEQ ID NO: 834 - protein, 10 aa, Artificial Sequence
  Description of Artificial Sequence: Synthetic peptide
GTTSSMNAIG

SEQ ID NO: 835 - protein, 10 aa, Artificial Sequence
  Description of Artificial Sequence: Synthetic peptide
GETSSINAMA

SEQ ID NO: 836 - protein, 10 aa, Artificial Sequence
  Description of Artificial Sequence: Synthetic peptide
GSTSTINAIG

SEQ ID NO: 837 - protein, 10 aa, Artificial Sequence
  Description of Artificial Sequence: Synthetic peptide
GSTYSMNAMG

SEQ ID NO: 838 - protein, 10 aa, Artificial Sequence
  Description of Artificial Sequence: Synthetic peptide
GSPSSINAYG

SEQ ID NO: 839 - protein, 10 aa, Artificial Sequence
  Description of Artificial Sequence: Synthetic peptide
GSTSTINAIG

SEQ ID NO: 840 - protein, 10 aa, Artificial Sequence
  Description of Artificial Sequence: Synthetic peptide
GSTSSINAIG

SEQ ID NO: 841 - protein, 10 aa, Artificial Sequence
  Description of Artificial Sequence: Synthetic peptide
GSISSINAMG

SEQ ID NO: 842 - protein, 10 aa, Artificial Sequence
  Description of Artificial Sequence: Synthetic peptide
GSTQVNNAMA

SEQ ID NO: 843 - protein, 10 aa, Artificial Sequence
  Description of Artificial Sequence: Synthetic peptide
GSTASFNAMA

SEQ ID NO: 844 - protein, 10 aa, Artificial Sequence
  Description of Artificial Sequence: Synthetic peptide
GSPLSINAIG

SEQ ID NO: 845 - protein, 10 aa, Artificial Sequence
  Description of Artificial Sequence: Synthetic peptide
GSTTFINAIG

SEQ ID NO: 846 - protein, 10 aa, Artificial Sequence
  Description of Artificial Sequence: Synthetic peptide
GSTSSINAIG

SEQ ID NO: 847 - protein, 10 aa, Artificial Sequence
  Description of Artificial Sequence: Synthetic peptide
GETDTINAVG

SEQ ID NO: 848 - protein, 10 aa, Artificial Sequence
  Description of Artificial Sequence: Synthetic peptide
GSTSPINAIG

SEQ ID NO: 849 - protein, 10 aa, Artificial Sequence
  Description of Artificial Sequence: Synthetic peptide
GSITSSNAMG

SEQ ID NO: 850 - protein, 10 aa, Artificial Sequence
  Description of Artificial Sequence: Synthetic peptide
RYSVSNLSMA

SEQ ID NO: 851 - protein, 10 aa, Artificial Sequence
  Description of Artificial Sequence: Synthetic peptide
MSTVSVLSMA

SEQ ID NO: 852 - protein, 10 aa, Artificial Sequence
  Description of Artificial Sequence: Synthetic peptide
DSYVSLLSMA

SEQ ID NO: 853 - protein, 10 aa, Artificial Sequence
  Description of Artificial Sequence: Synthetic peptide
DSAVSVLSIA

SEQ ID NO: 854 - protein, 10 aa, Artificial Sequence
  Description of Artificial Sequence: Synthetic peptide
HSSVTSLSLA

SEQ ID NO: 855 - protein, 10 aa, Artificial Sequence
  Description of Artificial Sequence: Synthetic peptide
DSVVKFLSMA

SEQ ID NO: 856 - protein, 10 aa, Artificial Sequence
  Description of Artificial Sequence: Synthetic peptide
DPSVWNLSMA

SEQ ID NO: 857 - protein, 10 aa, Artificial Sequence
  Description of Artificial Sequence: Synthetic peptide
GTSVMLLSLA

SEQ ID NO: 858 - protein, 10 aa, Artificial Sequence
  Description of Artificial Sequence: Synthetic peptide
SSPVSNLSLA

SEQ ID NO: 859 - protein, 10 aa, Artificial Sequence
  Description of Artificial Sequence: Synthetic peptide
WRSVLLLSVA

SEQ ID NO: 860 - protein, 10 aa, Artificial Sequence
  Description of Artificial Sequence: Synthetic peptide
SSSVQYLSMA

SEQ ID NO: 861 - protein, 10 aa, Artificial Sequence
  Description of Artificial Sequence: Synthetic peptide
GTSVSLLSLA

SEQ ID NO: 862 - protein, 10 aa, Artificial Sequence
  Description of Artificial Sequence: Synthetic peptide
LSSVSNLSIA

SEQ ID NO: 863 - protein, 10 aa, Artificial Sequence
  Description of Artificial Sequence: Synthetic peptide
MYSVSFLSMA

SEQ ID NO: 864 - protein, 10 aa, Artificial Sequence
  Description of Artificial Sequence: Synthetic peptide
KSSVSHLSLA

SEQ ID NO: 865 - protein, 10 aa, Artificial Sequence
  Description of Artificial Sequence: Synthetic peptide
YTSVLDLSIA

SEQ ID NO: 866 - protein, 10 aa, Artificial Sequence
  Description of Artificial Sequence: Synthetic peptide
MSDVSFLSMA

SEQ ID NO: 867 - protein, 10 aa, Artificial Sequence
  Description of Artificial Sequence: Synthetic peptide
ESSVSFLSSA

SEQ ID NO: 868 - protein, 10 aa, Artificial Sequence
  Description of Artificial Sequence: Synthetic peptide
GDSVSLLSMA

SEQ ID NO: 869 - protein, 10 aa, Artificial Sequence
  Description of Artificial Sequence: Synthetic peptide
GSDVWYLSLA

SEQ ID NO: 870 - protein, 10 aa, Artificial Sequence
  Description of Artificial Sequence: Synthetic peptide
KSAVAFLSIA

SEQ ID NO: 871 - protein, 10 aa, Artificial Sequence
  Description of Artificial Sequence: Synthetic peptide
FSAVAYLSMA

SEQ ID NO: 872 - protein, 10 aa, Artificial Sequence
  Description of Artificial Sequence: Synthetic peptide
VYSVYDLSTA

SEQ ID NO: 873 - protein, 10 aa, Artificial Sequence
  Description of Artificial Sequence: Synthetic peptide
GDSVSFLSMA

SEQ ID NO: 874 - protein, 10 aa, Artificial Sequence
  Description of Artificial Sequence: Synthetic peptide
SSSVSLLSLA

SEQ ID NO: 875 - protein, 10 aa, Artificial Sequence
  Description of Artificial Sequence: Synthetic peptide
ADSVSFLSIA

SEQ ID NO: 876 - protein, 10 aa, Artificial Sequence
  Description of Artificial Sequence: Synthetic peptide
ASSVTLLSIA

SEQ ID NO: 877 - protein, 10 aa, Artificial Sequence
  Description of Artificial Sequence: Synthetic peptide
ADSVSFLSIA

SEQ ID NO: 878 - protein, 10 aa, Artificial Sequence
  Description of Artificial Sequence: Synthetic peptide
GTSVWLLSMA

SEQ ID NO: 879 - protein, 10 aa, Artificial Sequence
  Description of Artificial Sequence: Synthetic peptide
GSSVSILSIA

SEQ ID NO: 880 - protein, 10 aa, Artificial Sequence
  Description of Artificial Sequence: Synthetic peptide
GTAVSNLSIA

SEQ ID NO: 881 - protein, 10 aa, Artificial Sequence
  Description of Artificial Sequence: Synthetic peptide
GSAVSMLSLA

SEQ ID NO: 882 - protein, 10 aa, Artificial Sequence
  Description of Artificial Sequence: Synthetic peptide
GMTVFFLSMA

SEQ ID NO: 883 - protein, 10 aa, Artificial Sequence
  Description of Artificial Sequence: Synthetic peptide
QYSVTFLSVA

SEQ ID NO: 884 - protein, 10 aa, Artificial Sequence
  Description of Artificial Sequence: Synthetic peptide
GETVSFLSLA

SEQ ID NO: 885 - protein, 16 aa, Artificial Sequence
  Description of Artificial Sequence: Synthetic peptide
VITSFSSTNYADSVKG

SEQ ID NO: 886 - protein, 16 aa, Artificial Sequence
  Description of Artificial Sequence: Synthetic peptide
VITSFSSTNYADSVKG

SEQ ID NO: 887 - protein, 16 aa, Artificial Sequence
  Description of Artificial Sequence: Synthetic peptide
AITSFSSTNYADSVKG

SEQ ID NO: 888 - protein, 16 aa, Artificial Sequence
  Description of Artificial Sequence: Synthetic peptide
RITSGGSTNYADSVKG

SEQ ID NO: 889 - protein, 16 aa, Artificial Sequence
  Description of Artificial Sequence: Synthetic peptide
AITSFGSTNYADSVKD

SEQ ID NO: 890 - protein, 16 aa, Artificial Sequence
  Description of Artificial Sequence: Synthetic peptide
AITTFDYTNYADSVKG

SEQ ID NO: 891 - protein, 16 aa, Artificial Sequence
  Description of Artificial Sequence: Synthetic peptide
AITSFGSTNYADSVKG

SEQ ID NO: 892 - protein, 16 aa, Artificial Sequence
  Description of Artificial Sequence: Synthetic peptide
TLTSGGNTNYADSVKG

SEQ ID NO: 893 - protein, 16 aa, Artificial Sequence
  Description of Artificial Sequence: Synthetic peptide
TLTSGGNTNYADSVKG

SEQ ID NO: 894 - protein, 16 aa, Artificial Sequence
  Description of Artificial Sequence: Synthetic peptide
TLTSGGNTNYADSVKG

SEQ ID NO: 895 - protein, 16 aa, Artificial Sequence
  Description of Artificial Sequence: Synthetic peptide
TLTSGGNTNYADSVKG

SEQ ID NO: 896 - protein, 16 aa, Artificial Sequence
  Description of Artificial Sequence: Synthetic peptide
SLTSEGLTNYRDSVKG

SEQ ID NO: 897 - protein, 16 aa, Artificial Sequence
  Description of Artificial Sequence: Synthetic peptide
AITTWGSTNYADSVKG

SEQ ID NO: 898 - protein, 16 aa, Artificial Sequence
  Description of Artificial Sequence: Synthetic peptide
AITSYGSTNYADSVKG

SEQ ID NO: 899 - protein, 16 aa, Artificial Sequence
  Description of Artificial Sequence: Synthetic peptide
AITTYGSTNYIDSVKG

SEQ ID NO: 900 - protein, 16 aa, Artificial Sequence
  Description of Artificial Sequence: Synthetic peptide
RITTFGTTNYADSVKG

SEQ ID NO: 901 - protein, 17 aa, Artificial Sequence
  Description of Artificial Sequence: Synthetic peptide
RITSSGFSTNYADSVKG

SEQ ID NO: 902 - protein, 17 aa, Artificial Sequence
  Description of Artificial Sequence: Synthetic peptide
RITSSGFSTNYADSVKG

SEQ ID NO: 903 - protein, 16 aa, Artificial Sequence
  Description of Artificial Sequence: Synthetic peptide
NMHSGGSTNYADSVKG

SEQ ID NO: 904 - protein, 16 aa, Artificial Sequence
  Description of Artificial Sequence: Synthetic peptide
GISVDGSTNYADSVKG

SEQ ID NO: 905 - protein, 16 aa, Artificial Sequence
  Description of Artificial Sequence: Synthetic peptide
GISVDGSTNYADSVKG

SEQ ID NO: 906 - protein, 16 aa, Artificial Sequence
  Description of Artificial Sequence: Synthetic peptide
GISVDGSTNYADSVKG

SEQ ID NO: 907 - protein, 16 aa, Artificial Sequence
  Description of Artificial Sequence: Synthetic peptide
GISVDGSTNYADSVKG

SEQ ID NO: 908 - protein, 16 aa, Artificial Sequence
  Description of Artificial Sequence: Synthetic peptide
GISVDGSTNYADSVKG

SEQ ID NO: 909 - protein, 16 aa, Artificial Sequence
  Description of Artificial Sequence: Synthetic peptide
GISTDGSTNYVDSVKG

SEQ ID NO: 910 - protein, 16 aa, Artificial Sequence
  Description of Artificial Sequence: Synthetic peptide
GISTDGTTNYVDSVKD

SEQ ID NO: 911 - protein, 16 aa, Artificial Sequence
  Description of Artificial Sequence: Synthetic peptide
GISTDGTTNYVDSVKD

SEQ ID NO: 912 - protein, 16 aa, Artificial Sequence
  Description of Artificial Sequence: Synthetic peptide
GISTDGTTNYVDSVKD

SEQ ID NO: 913 - protein, 16 aa, Artificial Sequence
  Description of Artificial Sequence: Synthetic peptide
GISTDGSTNYADSVKG

SEQ ID NO: 914 - protein, 16 aa, Artificial Sequence
  Description of Artificial Sequence: Synthetic peptide
GISTDGSTNYADSVKG

SEQ ID NO: 915 - protein, 16 aa, Artificial Sequence
  Description of Artificial Sequence: Synthetic peptide
GISTDGSTNYADSVKG

SEQ ID NO: 916 - protein, 16 aa, Artificial Sequence
  Description of Artificial Sequence: Synthetic peptide
GISSDGSTNYVDSVKG

SEQ ID NO: 917 - protein, 16 aa, Artificial Sequence
  Description of Artificial Sequence: Synthetic peptide
GISADGSTDYIDSVKG

SEQ ID NO: 918 - protein, 16 aa, Artificial Sequence
  Description of Artificial Sequence: Synthetic peptide
GISSDGSTHYVDSVKG

SEQ ID NO: 919 - protein, 16 aa, Artificial Sequence
  Description of Artificial Sequence: Synthetic peptide
GISSDGSKNYADSVKG

SEQ ID NO: 920 - protein, 16 aa, Artificial Sequence
  Description of Artificial Sequence: Synthetic peptide
GISSDGSKVYADSVKG

SEQ ID NO: 921 - protein, 16 aa, Artificial Sequence
  Description of Artificial Sequence: Synthetic peptide
GSSSDGSTHYVDSVRG

SEQ ID NO: 922 - protein, 16 aa, Artificial Sequence
  Description of Artificial Sequence: Synthetic peptide
IIRSGGSSNYADTVKG

SEQ ID NO: 923 - protein, 16 aa, Artificial Sequence
  Description of Artificial Sequence: Synthetic peptide
LITSGGSSNYADTVKG

SEQ ID NO: 924 - protein, 16 aa, Artificial Sequence
  Description of Artificial Sequence: Synthetic peptide
IITSGGSSNYADTVKG

SEQ ID NO: 925 - protein, 16 aa, Artificial Sequence
  Description of Artificial Sequence: Synthetic peptide
TIFDGSYTNYADSVKG

SEQ ID NO: 926 - protein, 16 aa, Artificial Sequence
  Description of Artificial Sequence: Synthetic peptide
SITTFGSTNYADPVKG

SEQ ID NO: 927 - protein, 16 aa, Artificial Sequence
  Description of Artificial Sequence: Synthetic peptide
TITRDGTRNYADSLKG

SEQ ID NO: 928 - protein, 16 aa, Artificial Sequence
  Description of Artificial Sequence: Synthetic peptide
TISRGGTRTYADSVKG

SEQ ID NO: 929 - protein, 16 aa, Artificial Sequence
  Description of Artificial Sequence: Synthetic peptide
LIGSAGSTKYADSVKG

SEQ ID NO: 930 - protein, 16 aa, Artificial Sequence
  Description of Artificial Sequence: Synthetic peptide
RITSGGITKYADSVKG

SEQ ID NO: 931 - protein, 16 aa, Artificial Sequence
  Description of Artificial Sequence: Synthetic peptide
RITSGGITKYADSVKG

SEQ ID NO: 932 - protein, 16 aa, Artificial Sequence
  Description of Artificial Sequence: Synthetic peptide
RITSGGITKYADSVKG

SEQ ID NO: 933 - protein, 16 aa, Artificial Sequence
  Description of Artificial Sequence: Synthetic peptide
RITSGGITKYADSVKG

SEQ ID NO: 934 - protein, 16 aa, Artificial Sequence
  Description of Artificial Sequence: Synthetic peptide
AITTSGNTSYADSVKG

SEQ ID NO: 935 - protein, 16 aa, Artificial Sequence
  Description of Artificial Sequence: Synthetic peptide
VITRGGATNYADSVKG

SEQ ID NO: 936 - protein, 16 aa, Artificial Sequence
  Description of Artificial Sequence: Synthetic peptide
SIAGDGRTNYAESTEG

SEQ ID NO: 937 - protein, 16 aa, Artificial Sequence
  Description of Artificial Sequence: Synthetic peptide
VITSFSSTNYADSVKG

SEQ ID NO: 938 - protein, 16 aa, Artificial Sequence
  Description of Artificial Sequence: Synthetic peptide
IIRSGGSSNYADTVKG

SEQ ID NO: 939 - protein, 16 aa, Artificial Sequence
  Description of Artificial Sequence: Synthetic peptide
GISVDGSTNYADSVKG

SEQ ID NO: 940 - protein, 16 aa, Artificial Sequence
  Description of Artificial Sequence: Synthetic peptide
AITTSGNTSYADSVKG

SEQ ID NO: 941 - protein, 16 aa, Artificial Sequence
  Description of Artificial Sequence: Synthetic peptide
TLTSGGNTNYADSVKG

SEQ ID NO: 942 - protein, 16 aa, Artificial Sequence
  Description of Artificial Sequence: Synthetic peptide
TLTSGGNTNYADSVKG

SEQ ID NO: 943 - protein, 16 aa, Artificial Sequence
  Description of Artificial Sequence: Synthetic peptide
AITTFDYTNYADSVKG

SEQ ID NO: 944 - protein, 16 aa, Artificial Sequence
  Description of Artificial Sequence: Synthetic peptide
GISSDGSKNYADSVKG

SEQ ID NO: 945 - protein, 16 aa, Artificial Sequence
  Description of Artificial Sequence: Synthetic peptide
AITSYGSTNYADSVKG

SEQ ID NO: 946 - protein, 16 aa, Artificial Sequence
  Description of Artificial Sequence: Synthetic peptide
IITSGGSSNYADTVKG

SEQ ID NO: 947 - protein, 17 aa, Artificial Sequence
  Description of Artificial Sequence: Synthetic peptide
RITSSGFSTNYADSVKG

SEQ ID NO: 948 - protein, 16 aa, Artificial Sequence
  Description of Artificial Sequence: Synthetic peptide
VITRGGATNYADSVKG

SEQ ID NO: 949 - protein, 16 aa, Artificial Sequence
  Description of Artificial Sequence: Synthetic peptide
RITSGGSTNYADSVKG

SEQ ID NO: 950 - protein, 16 aa, Artificial Sequence
  Description of Artificial Sequence: Synthetic peptide
RITSGGITKYADSVKG

SEQ ID NO: 951 - protein, 16 aa, Artificial Sequence
  Description of Artificial Sequence: Synthetic peptide
TIFDGSYTNYADSVKG

SEQ ID NO: 952 - protein, 16 aa, Artificial Sequence
  Description of Artificial Sequence: Synthetic peptide
GISSDGSKVYADSVKG

SEQ ID NO: 953 - protein, 16 aa, Artificial Sequence
  Description of Artificial Sequence: Synthetic peptide
SITTFGSTNYADPVKG

SEQ ID NO: 954 - protein, 16 aa, Artificial Sequence
  Description of Artificial Sequence: Synthetic peptide
AITTWGSTNYADSVKG

SEQ ID NO: 955 - protein, 17 aa, Artificial Sequence
  Description of Artificial Sequence: Synthetic peptide
RITSSGFSTNYADSVKG

SEQ ID NO: 956 - protein, 16 aa, Artificial Sequence
  Description of Artificial Sequence: Synthetic peptide
NMHSGGSTNYADSVKG

SEQ ID NO: 957 - protein, 16 aa, Artificial Sequence
  Description of Artificial Sequence: Synthetic peptide
GISTDGSTNYVDSVKG

SEQ ID NO: 958 - protein, 16 aa, Artificial Sequence
  Description of Artificial Sequence: Synthetic peptide
TITRDGTRNYADSLKG

SEQ ID NO: 959 - protein, 16 aa, Artificial Sequence
  Description of Artificial Sequence: Synthetic peptide
GISADGSTDYIDSVKG

SEQ ID NO: 960 - protein, 16 aa, Artificial Sequence
  Description of Artificial Sequence: Synthetic peptide
SIAGDGRTNYAESTEG

SEQ ID NO: 961 - protein, 16 aa, Artificial Sequence
  Description of Artificial Sequence: Synthetic peptide
GISVDGSTNYADSVKG

SEQ ID NO: 962 - protein, 16 aa, Artificial Sequence
  Description of Artificial Sequence: Synthetic peptide
RITTFGTTNYADSVKG

SEQ ID NO: 963 - protein, 16 aa, Artificial Sequence
  Description of Artificial Sequence: Synthetic peptide
TISRGGTRTYADSVKG

SEQ ID NO: 964 - protein, 16 aa, Artificial Sequence
  Description of Artificial Sequence: Synthetic peptide
AITSFGSTNYADSVKD

SEQ ID NO: 965 - protein, 16 aa, Artificial Sequence
  Description of Artificial Sequence: Synthetic peptide
LITSGGSSNYADTVKG

SEQ ID NO: 966 - protein, 16 aa, Artificial Sequence
  Description of Artificial Sequence: Synthetic peptide
SLTSEGLTNYRDSVKG

SEQ ID NO: 967 - protein, 16 aa, Artificial Sequence
  Description of Artificial Sequence: Synthetic peptide
GISSDGSTHYVDSVKG

SEQ ID NO: 968 - protein, 16 aa, Artificial Sequence
  Description of Artificial Sequence: Synthetic peptide
LIGSAGSTKYADSVKG

SEQ ID NO: 969 - protein, 16 aa, Artificial Sequence
  Description of Artificial Sequence: Synthetic peptide
GSSSDGSTHYVDSVRG

SEQ ID NO: 970 - protein, 16 aa, Artificial Sequence
  Description of Artificial Sequence: Synthetic peptide
AITSFGSTNYADSVKG

SEQ ID NO: 971 - protein, 16 aa, Artificial Sequence
  Description of Artificial Sequence: Synthetic peptide
GISSDGSFVYADSVKG

SEQ ID NO: 972 - protein, 16 aa, Artificial Sequence
  Description of Artificial Sequence: Synthetic peptide
GISSDGSKVYADSVKG

SEQ ID NO: 973 - protein, 16 aa, Artificial Sequence
  Description of Artificial Sequence: Synthetic peptide
GISSDGSKVYEDSVKG

SEQ ID NO: 974 - protein, 16 aa, Artificial Sequence
  Description of Artificial Sequence: Synthetic peptide
GISSDGSKVYADSVKG

SEQ ID NO: 975 - protein, 16 aa, Artificial Sequence
  Description of Artificial Sequence: Synthetic peptide
GISSDGSSVYADSVKG

SEQ ID NO: 976 - protein, 16 aa, Artificial Sequence
  Description of Artificial Sequence: Synthetic peptide
GISSDGSKVYADSVKG

SEQ ID NO: 977 - protein, 16 aa, Artificial Sequence
  Description of Artificial Sequence: Synthetic peptide
GISSDGSKLYADSVKG

SEQ ID NO: 978 - protein, 16 aa, Artificial Sequence
  Description of Artificial Sequence: Synthetic peptide
GISSDGSKVYADSVKG

SEQ ID NO: 979 - protein, 16 aa, Artificial Sequence
  Description of Artificial Sequence: Synthetic peptide
GISSDGSKVYIDSVKG

SEQ ID NO: 980 - protein, 16 aa, Artificial Sequence
  Description of Artificial Sequence: Synthetic peptide
GISSDGSKVYSDSVKG

SEQ ID NO: 981 - protein, 16 aa, Artificial Sequence
  Description of Artificial Sequence: Synthetic peptide
GISSDGSKVIADSVKG

SEQ ID NO: 982 - protein, 16 aa, Artificial Sequence
  Description of Artificial Sequence: Synthetic peptide
GISSDGSKIYADSVKG

SEQ ID NO: 983 - protein, 16 aa, Artificial Sequence
  Description of Artificial Sequence: Synthetic peptide
GISSDGSKVYTDSVKG

SEQ ID NO: 984 - protein, 16 aa, Artificial Sequence
  Description of Artificial Sequence: Synthetic peptide
GISSDGSLVYADSVKG

SEQ ID NO: 985 - protein, 16 aa, Artificial Sequence
  Description of Artificial Sequence: Synthetic peptide
GISSDGSKVYADSVKG

SEQ ID NO: 986 - protein, 16 aa, Artificial Sequence
  Description of Artificial Sequence: Synthetic peptide
GISSDGSKVYSDSVKG

SEQ ID NO: 987 - protein, 16 aa, Artificial Sequence
  Description of Artificial Sequence: Synthetic peptide
GISSDGSKVYVDSVKG

SEQ ID NO: 988 - protein, 16 aa, Artificial Sequence
  Description of Artificial Sequence: Synthetic peptide
GISSDGSKVYVDSVKG

SEQ ID NO: 989 - protein, 16 aa, Artificial Sequence
  Description of Artificial Sequence: Synthetic peptide
GISSDGSKVYADSVKG

SEQ ID NO: 990 - protein, 16 aa, Artificial Sequence
  Description of Artificial Sequence: Synthetic peptide
GISSDGSKVYADSVKG

SEQ ID NO: 991 - protein, 16 aa, Artificial Sequence
  Description of Artificial Sequence: Synthetic peptide
GISSDGSKVYRDSVKG

SEQ ID NO: 992 - protein, 16 aa, Artificial Sequence
  Description of Artificial Sequence: Synthetic peptide
GISSDGSKVYSDSVKG

SEQ ID NO: 993 - protein, 16 aa, Artificial Sequence
  Description of Artificial Sequence: Synthetic peptide
GISSDNSKVYADSVKG

SEQ ID NO: 994 - protein, 16 aa, Artificial Sequence
  Description of Artificial Sequence: Synthetic peptide
GISSDGSKVYADSVKG

SEQ ID NO: 995 - protein, 16 aa, Artificial Sequence
  Description of Artificial Sequence: Synthetic peptide
GISSDGSKVYADSVKG

SEQ ID NO: 996 - protein, 16 aa, Artificial Sequence
  Description of Artificial Sequence: Synthetic peptide
GISSDGSKVYEDSVKG

SEQ ID NO: 997 - protein, 16 aa, Artificial Sequence
  Description of Artificial Sequence: Synthetic peptide
GISSDGSKVYADSVKG

SEQ ID NO: 998 - protein, 16 aa, Artificial Sequence
  Description of Artificial Sequence: Synthetic peptide
GISSDGSKVYAVSVKG

SEQ ID NO: 999 - protein, 16 aa, Artificial Sequence
  Description of Artificial Sequence: Synthetic peptide
GVSSDGSKVYADSVKG

SEQ ID NO: 1000 - protein, 16 aa, Artificial Sequence
  Description of Artificial Sequence: Synthetic peptide
GISSDGSKVYEDSVKG

SEQ ID NO: 1001 - protein, 16 aa, Artificial Sequence
  Description of Artificial Sequence: Synthetic peptide
GISSDGSKVYAGSVKG

SEQ ID NO: 1002 - protein, 16 aa, Artificial Sequence
  Description of Artificial Sequence: Synthetic peptide
GISSDKSKVYADSVKG

SEQ ID NO: 1003 - protein, 16 aa, Artificial Sequence
  Description of Artificial Sequence: Synthetic peptide
GISSNGSKVYADSVKG

SEQ ID NO: 1004 - protein, 16 aa, Artificial Sequence
  Description of Artificial Sequence: Synthetic peptide
GISSDGSKVLADSVKG

SEQ ID NO: 1005 - protein, 16 aa, Artificial Sequence
  Description of Artificial Sequence: Synthetic peptide
GISSDGSKVYADSVKG

SEQ ID NO: 1006 - protein, 16 aa, Artificial Sequence
  Description of Artificial Sequence: Synthetic peptide
GISSDNSKVYADSVKG

SEQ ID NO: 1007 - protein, 16 aa, Artificial Sequence
  Description of Artificial Sequence: Synthetic peptide
GISSDGSKVYADSVKG

SEQ ID NO: 1008 - protein, 16 aa, Artificial Sequence
  Description of Artificial Sequence: Synthetic peptide
GISSDGSKVYTDSVKG

SEQ ID NO: 1009 - protein, 16 aa, Artificial Sequence
  Description of Artificial Sequence: Synthetic peptide
GISSDGSKVYTDSVKG

SEQ ID NO: 1010 - protein, 16 aa, Artificial Sequence
  Description of Artificial Sequence: Synthetic peptide
GISSDNSKVYADSVKG

SEQ ID NO: 1011 - protein, 16 aa, Artificial Sequence
  Description of Artificial Sequence: Synthetic peptide
GISSDGSRVYADSVKG

SEQ ID NO: 1012 - protein, 16 aa, Artificial Sequence
  Description of Artificial Sequence: Synthetic peptide
GISSDGSQVYADSVKG

SEQ ID NO: 1013 - protein, 16 aa, Artificial Sequence
  Description of Artificial Sequence: Synthetic peptide
GISSDGSKAYADSVKG

SEQ ID NO: 1014 - protein, 16 aa, Artificial Sequence
  Description of Artificial Sequence: Synthetic peptide
GISSDGSKVYAKSAKG

SEQ ID NO: 1015 - protein, 16 aa, Artificial Sequence
  Description of Artificial Sequence: Synthetic peptide
GISSDGSKVYNDSVKG

SEQ ID NO: 1016 - protein, 16 aa, Artificial Sequence
  Description of Artificial Sequence: Synthetic peptide
GISSDGSKVIADSVKG

SEQ ID NO: 1017 - protein, 16 aa, Artificial Sequence
  Description of Artificial Sequence: Synthetic peptide
GISSDGSKVYTDSVKG

SEQ ID NO: 1018 - protein, 16 aa, Artificial Sequence
  Description of Artificial Sequence: Synthetic peptide
GISSDGSKVYIDSVKG

SEQ ID NO: 1019 - protein, 16 aa, Artificial Sequence
  Description of Artificial Sequence: Synthetic peptide
GISSDGSKVYYDSVKG

SEQ ID NO: 1020 - protein, 16 aa, Artificial Sequence
  Description of Artificial Sequence: Synthetic peptide
GISSDGSKVYVDSVKG

SEQ ID NO: 1021 - protein, 16 aa, Artificial Sequence
  Description of Artificial Sequence: Synthetic peptide
GISSDGSKVYGDSVKG

SEQ ID NO: 1022 - protein, 16 aa, Artificial Sequence
  Description of Artificial Sequence: Synthetic peptide
GISSDQSKVYADSAKG

SEQ ID NO: 1023 - protein, 16 aa, Artificial Sequence
  Description of Artificial Sequence: Synthetic peptide
GISSDGSKVYSDSVKG

SEQ ID NO: 1024 - protein, 16 aa, Artificial Sequence
  Description of Artificial Sequence: Synthetic peptide
GISSDGSKVYADSVKG

SEQ ID NO: 1025 - protein, 16 aa, Artificial Sequence
  Description of Artificial Sequence: Synthetic peptide
GISSDGSKVIADSVKG

SEQ ID NO: 1026 - protein, 16 aa, Artificial Sequence
  Description of Artificial Sequence: Synthetic peptide
GISSDGSKVDADSVKG

SEQ ID NO: 1027 - protein, 16 aa, Artificial Sequence
  Description of Artificial Sequence: Synthetic peptide
GISSDGSKVYKDSVKG

SEQ ID NO: 1028 - protein, 16 aa, Artificial Sequence
  Description of Artificial Sequence: Synthetic peptide
GISSNGSKVYADSVKG

SEQ ID NO: 1029 - protein, 16 aa, Artificial Sequence
  Description of Artificial Sequence: Synthetic peptide
GISSDGSKVYKDSVKG

SEQ ID NO: 1030 - protein, 16 aa, Artificial Sequence
  Description of Artificial Sequence: Synthetic peptide
GISSDGSKVYADSVKG

SEQ ID NO: 1031 - protein, 16 aa, Artificial Sequence
  Description of Artificial Sequence: Synthetic peptide
GISSDGSKVYQDSVKG

SEQ ID NO: 1032 - protein, 16 aa, Artificial Sequence
  Description of Artificial Sequence: Synthetic peptide
GISSDGSKVYAESVKG

SEQ ID NO: 1033 - protein, 16 aa, Artificial Sequence
  Description of Artificial Sequence: Synthetic peptide
GISSDGSKVLADSVKG

SEQ ID NO: 1034 - protein, 16 aa, Artificial Sequence
  Description of Artificial Sequence: Synthetic peptide
GISSDGSKYYADSVKG

SEQ ID NO: 1035 - protein, 16 aa, Artificial Sequence
  Description of Artificial Sequence: Synthetic peptide
GISSDGSKVYAVSVKG

SEQ ID NO: 1036 - protein, 16 aa, Artificial Sequence
  Description of Artificial Sequence: Synthetic peptide
GISSDGSKVVADSVKG

SEQ ID NO: 1037 - protein, 16 aa, Artificial Sequence
  Description of Artificial Sequence: Synthetic peptide
GISSDGSKVYADSVKG

SEQ ID NO: 1038 - protein, 16 aa, Artificial Sequence
  Description of Artificial Sequence: Synthetic peptide
GISSDGSKVYADSVKG

SEQ ID NO: 1039 - protein, 16 aa, Artificial Sequence
  Description of Artificial Sequence: Synthetic peptide
GISSDNSKVYADSVKG

SEQ ID NO: 1040 - protein, 16 aa, Artificial Sequence
  Description of Artificial Sequence: Synthetic peptide
GISSDGSKVYAQSVKG

SEQ ID NO: 1041 - protein, 16 aa, Artificial Sequence
  Description of Artificial Sequence: Synthetic peptide
GISSDGSKVYVDSVKG

SEQ ID NO: 1042 - protein, 16 aa, Artificial Sequence
  Description of Artificial Sequence: Synthetic peptide
GISSDGSKVYSDSVKG

SEQ ID NO: 1043 - protein, 16 aa, Artificial Sequence
  Description of Artificial Sequence: Synthetic peptide
GISSDGSKVLADSVKG

SEQ ID NO: 1044 - protein, 16 aa, Artificial Sequence
  Description of Artificial Sequence: Synthetic peptide
GISSDGSKVYNDSVKG

SEQ ID NO: 1045 - protein, 16 aa, Artificial Sequence
  Description of Artificial Sequence: Synthetic peptide
GISSDGSKVYNDSVKG

SEQ ID NO: 1046 - protein, 16 aa, Artificial Sequence
  Description of Artificial Sequence: Synthetic peptide
GISSDGSKVYVDSVKG

SEQ ID NO: 1047 - protein, 16 aa, Artificial Sequence
  Description of Artificial Sequence: Synthetic peptide
GISSDGSKVVADSVKG

SEQ ID NO: 1048 - protein, 16 aa, Artificial Sequence
  Description of Artificial Sequence: Synthetic peptide
GISSDGSKVYGDSVKG

SEQ ID NO: 1049 - protein, 16 aa, Artificial Sequence
  Description of Artificial Sequence: Synthetic peptide
GISSDGSKVYTDSVKG

SEQ ID NO: 1050 - protein, 16 aa, Artificial Sequence
  Description of Artificial Sequence: Synthetic peptide
GISSDGSKVYNDSVKG

SEQ ID NO: 1051 - protein, 16 aa, Artificial Sequence
  Description of Artificial Sequence: Synthetic peptide
GISSDGSKVTADSVKG

SEQ ID NO: 1052 - protein, 16 aa, Artificial Sequence
  Description of Artificial Sequence: Synthetic peptide
GISSDGSKVYRDSVKG

SEQ ID NO: 1053 - protein, 16 aa, Artificial Sequence
  Description of Artificial Sequence: Synthetic peptide
GISSNGSKVYSDSVKG

SEQ ID NO: 1054 - protein, 16 aa, Artificial Sequence
  Description of Artificial Sequence: Synthetic peptide
GISSDGSKVYSDSVKG

SEQ ID NO: 1055 - protein, 16 aa, Artificial Sequence
  Description of Artificial Sequence: Synthetic peptide
GISSDGSKVYADSVKG

SEQ ID NO: 1056 - protein, 16 aa, Artificial Sequence
  Description of Artificial Sequence: Synthetic peptide
GISSDGSKVYADSVKG

SEQ ID NO: 1057 - protein, 16 aa, Artificial Sequence
  Description of Artificial Sequence: Synthetic peptide
GISSDGSLVYADSVKG

SEQ ID NO: 1058 - protein, 16 aa, Artificial Sequence
  Description of Artificial Sequence: Synthetic peptide
GISSDGTKVYADSVKG

SEQ ID NO: 1059 - protein, 16 aa, Artificial Sequence
  Description of Artificial Sequence: Synthetic peptide
GISSDGSKVYADSVKG

SEQ ID NO: 1060 - protein, 16 aa, Artificial Sequence
  Description of Artificial Sequence: Synthetic peptide
GISSDGSKLYLDSVKG

SEQ ID NO: 1061 - protein, 16 aa, Artificial Sequence
  Description of Artificial Sequence: Synthetic peptide
GISSDGSRVYADSVKG

SEQ ID NO: 1062 - protein, 16 aa, Artificial Sequence
  Description of Artificial Sequence: Synthetic peptide
GISSDGSKVYNDSVKG

SEQ ID NO: 1063 - protein, 16 aa, Artificial Sequence
  Description of Artificial Sequence: Synthetic peptide
GISSDGSKVYADSVKG

SEQ ID NO: 1064 - protein, 16 aa, Artificial Sequence
  Description of Artificial Sequence: Synthetic peptide
GISSDGSKVYVDSVKG

SEQ ID NO: 1065 - protein, 16 aa, Artificial Sequence
  Description of Artificial Sequence: Synthetic peptide
GISSDGSKLYADSVKG

SEQ ID NO: 1066 - protein, 16 aa, Artificial Sequence
  Description of Artificial Sequence: Synthetic peptide
GISSDGSKVYKDSVKG

SEQ ID NO: 1067 - protein, 16 aa, Artificial Sequence
  Description of Artificial Sequence: Synthetic peptide
GISSDGSKVYADSVKG

SEQ ID NO: 1068 - protein, 16 aa, Artificial Sequence
  Description of Artificial Sequence: Synthetic peptide
GISSDGSKVYQDSVKG

SEQ ID NO: 1069 - protein, 16 aa, Artificial Sequence
  Description of Artificial Sequence: Synthetic peptide
GISSDGTKIYADSAKV

SEQ ID NO: 1070 - protein, 16 aa, Artificial Sequence
  Description of Artificial Sequence: Synthetic peptide
GISSDRSKVYADSVKG

SEQ ID NO: 1071 - protein, 16 aa, Artificial Sequence
  Description of Artificial Sequence: Synthetic peptide
GISSDGSLVYADSVKG

SEQ ID NO: 1072 - protein, 16 aa, Artificial Sequence
  Description of Artificial Sequence: Synthetic peptide
GISSDGSKVYADSVKG

SEQ ID NO: 1073 - protein, 16 aa, Artificial Sequence
  Description of Artificial Sequence: Synthetic peptide
GISSDGSKVYRDSVKG

SEQ ID NO: 1074 - protein, 16 aa, Artificial Sequence
  Description of Artificial Sequence: Synthetic peptide
GISSDGSKVYADSVKG

SEQ ID NO: 1075 - protein, 16 aa, Artificial Sequence
  Description of Artificial Sequence: Synthetic peptide
GISSDGSKVYSDSVKG

SEQ ID NO: 1076 - protein, 16 aa, Artificial Sequence
  Description of Artificial Sequence: Synthetic peptide
GISSDGTKVYRDSVKG

SEQ ID NO: 1077 - protein, 16 aa, Artificial Sequence
  Description of Artificial Sequence: Synthetic peptide
GISSDGSKVYNDSVKG

SEQ ID NO: 1078 - protein, 16 aa, Artificial Sequence
  Description of Artificial Sequence: Synthetic peptide
GISSDGSKVYADSVKG

SEQ ID NO: 1079 - protein, 16 aa, Artificial Sequence
  Description of Artificial Sequence: Synthetic peptide
GISSDGSKVYADSVKG

SEQ ID NO: 1080 - protein, 16 aa, Artificial Sequence
  Description of Artificial Sequence: Synthetic peptide
GISSDGSKVYTDSVKG

SEQ ID NO: 1081 - protein, 16 aa, Artificial Sequence
  Description of Artificial Sequence: Synthetic peptide
GISPDGTKAYADSAKV

SEQ ID NO: 1082 - protein, 16 aa, Artificial Sequence
  Description of Artificial Sequence: Synthetic peptide
GISSDGSKVYVDSVKG

SEQ ID NO: 1083 - protein, 16 aa, Artificial Sequence
  Description of Artificial Sequence: Synthetic peptide
GISSDGSKVYSDSVKG

SEQ ID NO: 1084 - protein, 16 aa, Artificial Sequence
  Description of Artificial Sequence: Synthetic peptide
GISSDGSKVYASSVKG

SEQ ID NO: 1085 - protein, 16 aa, Artificial Sequence
  Description of Artificial Sequence: Synthetic peptide
GISADGSKVYADSVKG

SEQ ID NO: 1086 - protein, 16 aa, Artificial Sequence
  Description of Artificial Sequence: Synthetic peptide
GISSDGSKVYASSAKG

SEQ ID NO: 1087 - protein, 16 aa, Artificial Sequence
  Description of Artificial Sequence: Synthetic peptide
GISSDGSKVYADSVKG

SEQ ID NO: 1088 - protein, 16 aa, Artificial Sequence
  Description of Artificial Sequence: Synthetic peptide
GISSDGSSVYADSVKG

SEQ ID NO: 1089 - protein, 16 aa, Artificial Sequence
  Description of Artificial Sequence: Synthetic peptide
GISSDGSKVYSDSVKG

SEQ ID NO: 1090 - protein, 16 aa, Artificial Sequence
  Description of Artificial Sequence: Synthetic peptide
GISSDGSKVYAGSVKG

SEQ ID NO: 1091 - protein, 16 aa, Artificial Sequence
  Description of Artificial Sequence: Synthetic peptide
GISSDNSKVYADSVKG

SEQ ID NO: 1092 - protein, 16 aa, Artificial Sequence
  Description of Artificial Sequence: Synthetic peptide
GISSDGSAVYADSVKG

SEQ ID NO: 1093 - protein, 16 aa, Artificial Sequence
  Description of Artificial Sequence: Synthetic peptide
GISSDGSSVYADSVKG

SEQ ID NO: 1094 - protein, 16 aa, Artificial Sequence
  Description of Artificial Sequence: Synthetic peptide
GISSNGTKVYADSAKV

SEQ ID NO: 1095 - protein, 16 aa, Artificial Sequence
  Description of Artificial Sequence: Synthetic peptide
GISSDGSKLYADSVKG

SEQ ID NO: 1096 - protein, 16 aa, Artificial Sequence
  Description of Artificial Sequence: Synthetic peptide
GISSDGSKVYKDSVKG

SEQ ID NO: 1097 - protein, 16 aa, Artificial Sequence
  Description of Artificial Sequence: Synthetic peptide
GISSDGSLVYADSVKG

SEQ ID NO: 1098 - protein, 16 aa, Artificial Sequence
  Description of Artificial Sequence: Synthetic peptide
GISSDGSLVYADSVKG

SEQ ID NO: 1099 - protein, 16 aa, Artificial Sequence
  Description of Artificial Sequence: Synthetic peptide
GISSDGSKVYADSVKG

SEQ ID NO: 1100 - protein, 16 aa, Artificial Sequence
  Description of Artificial Sequence: Synthetic peptide
GISSDGSKVYADSVKG

SEQ ID NO: 1101 - protein, 16 aa, Artificial Sequence
  Description of Artificial Sequence: Synthetic peptide
GVSSDGSKVYADSVKG

SEQ ID NO: 1102 - protein, 16 aa, Artificial Sequence
  Description of Artificial Sequence: Synthetic peptide
GISRDGSKVYADSVKG

SEQ ID NO: 1103 - protein, 16 aa, Artificial Sequence
  Description of Artificial Sequence: Synthetic peptide
GISSDGSKLYADSVKG

SEQ ID NO: 1104 - protein, 16 aa, Artificial Sequence
  Description of Artificial Sequence: Synthetic peptide
GISSDGSKVYADSVKG

SEQ ID NO: 1105 - protein, 16 aa, Artificial Sequence
  Description of Artificial Sequence: Synthetic peptide
GISSDGSKVYADSVKG

SEQ ID NO: 1106 - protein, 16 aa, Artificial Sequence
  Description of Artificial Sequence: Synthetic peptide
GISSDGSKVYADSVKG

SEQ ID NO: 1107 - protein, 16 aa, Artificial Sequence
  Description of Artificial Sequence: Synthetic peptide
GISSDTSKVYADSVKG

SEQ ID NO: 1108 - protein, 16 aa, Artificial Sequence
  Description of Artificial Sequence: Synthetic peptide
GISSDGSKVYADSVKG

SEQ ID NO: 1109 - protein, 16 aa, Artificial Sequence
  Description of Artificial Sequence: Synthetic peptide
GISSDGSTVYADSVKG

SEQ ID NO: 1110 - protein, 16 aa, Artificial Sequence
  Description of Artificial Sequence: Synthetic peptide
GISKDGSKVYADSAKG

SEQ ID NO: 1111 - protein, 16 aa, Artificial Sequence
  Description of Artificial Sequence: Synthetic peptide
GISSDGSKVYSDSVKG

SEQ ID NO: 1112 - protein, 16 aa, Artificial Sequence
  Description of Artificial Sequence: Synthetic peptide
GISSDGSKVYSDSVKG

SEQ ID NO: 1113 - protein, 16 aa, Artificial Sequence
  Description of Artificial Sequence: Synthetic peptide
GISADGSTDYIDSVKG

SEQ ID NO: 1114 - protein, 16 aa, Artificial Sequence
  Description of Artificial Sequence: Synthetic peptide
GISADGSTAYIDSVKG

SEQ ID NO: 1115 - protein, 16 aa, Artificial Sequence
  Description of Artificial Sequence: Synthetic peptide
GISRDGSTDYIDSVKG

SEQ ID NO: 1116 - protein, 16 aa, Artificial Sequence
  Description of Artificial Sequence: Synthetic peptide
GISRDGSTDYIDSVKG

SEQ ID NO: 1117 - protein, 16 aa, Artificial Sequence
  Description of Artificial Sequence: Synthetic peptide
GISEAGSTDYIDSVKG

SEQ ID NO: 1118 - protein, 16 aa, Artificial Sequence
  Description of Artificial Sequence: Synthetic peptide
GISADGSTDYVDSVKG

SEQ ID NO: 1119 - protein, 16 aa, Artificial Sequence
  Description of Artificial Sequence: Synthetic peptide
GISADGSTDYIRSVKG

SEQ ID NO: 1120 - protein, 16 aa, Artificial Sequence
  Description of Artificial Sequence: Synthetic peptide
GISADGSVDYIDSVKG

SEQ ID NO: 1121 - protein, 16 aa, Artificial Sequence
  Description of Artificial Sequence: Synthetic peptide
GISADGSTLYIDSVKG

SEQ ID NO: 1122 - protein, 16 aa, Artificial Sequence
  Description of Artificial Sequence: Synthetic peptide
GISTDGSTDYIDSVKG

SEQ ID NO: 1123 - protein, 16 aa, Artificial Sequence
  Description of Artificial Sequence: Synthetic peptide
GISGDGSTDYIDSVKG

SEQ ID NO: 1124 - protein, 16 aa, Artificial Sequence
  Description of Artificial Sequence: Synthetic peptide
GISADGSTDYINSVKG

SEQ ID NO: 1125 - protein, 16 aa, Artificial Sequence
  Description of Artificial Sequence: Synthetic peptide
GISARGSTDYIDSVKG

SEQ ID NO: 1126 - protein, 16 aa, Artificial Sequence
  Description of Artificial Sequence: Synthetic peptide
GISADGSTTYIDSVKG

SEQ ID NO: 1127 - protein, 16 aa, Artificial Sequence
  Description of Artificial Sequence: Synthetic peptide
GISKDGSTDYIDSVKG

SEQ ID NO: 1128 - protein, 16 aa, Artificial Sequence
  Description of Artificial Sequence: Synthetic peptide
GISADGSTTYIDSVKG

SEQ ID NO: 1129 - protein, 16 aa, Artificial Sequence
  Description of Artificial Sequence: Synthetic peptide
GISANGSTDYIDSVKG

SEQ ID NO: 1130 - protein, 16 aa, Artificial Sequence
  Description of Artificial Sequence: Synthetic peptide
GISRDGSTDYIDSVKG

SEQ ID NO: 1131 - protein, 16 aa, Artificial Sequence
  Description of Artificial Sequence: Synthetic peptide
GISADGSADYIDSVKG

SEQ ID NO: 1132 - protein, 16 aa, Artificial Sequence
  Description of Artificial Sequence: Synthetic peptide
GISAHGSTDYIDSVKG

SEQ ID NO: 1133 - protein, 16 aa, Artificial Sequence
  Description of Artificial Sequence: Synthetic peptide
GISADGSTIYIDSVKG

SEQ ID NO: 1134 - protein, 16 aa, Artificial Sequence
  Description of Artificial Sequence: Synthetic peptide
GISRDGSTVYIDSVKG

SEQ ID NO: 1135 - protein, 16 aa, Artificial Sequence
  Description of Artificial Sequence: Synthetic peptide
GISADGPTDYIDSVKG

SEQ ID NO: 1136 - protein, 16 aa, Artificial Sequence
  Description of Artificial Sequence: Synthetic peptide
GISADGSTTYIDSVKG

SEQ ID NO: 1137 - protein, 16 aa, Artificial Sequence
  Description of Artificial Sequence: Synthetic peptide
GISADGSTDYIASVKG

SEQ ID NO: 1138 - protein, 16 aa, Artificial Sequence
  Description of Artificial Sequence: Synthetic peptide
GISLDGSTDYIDSVKG

SEQ ID NO: 1139 - protein, 16 aa, Artificial Sequence
  Description of Artificial Sequence: Synthetic peptide
GISADGSTIYIDSVKG

SEQ ID NO: 1140 - protein, 16 aa, Artificial Sequence
  Description of Artificial Sequence: Synthetic peptide
GISAHGSTDYIDSVKG

SEQ ID NO: 1141 - protein, 16 aa, Artificial Sequence
  Description of Artificial Sequence: Synthetic peptide
GISRDGSTDYIDSVKG

SEQ ID NO: 1142 - protein, 16 aa, Artificial Sequence
  Description of Artificial Sequence: Synthetic peptide
GISRDGSTDYIDSVKG

SEQ ID NO: 1143 - protein, 16 aa, Artificial Sequence
  Description of Artificial Sequence: Synthetic peptide
GISADGSMDYIDSVKG

SEQ ID NO: 1144 - protein, 16 aa, Artificial Sequence
  Description of Artificial Sequence: Synthetic peptide
GISADGSTDYIDSVKG

SEQ ID NO: 1145 - protein, 16 aa, Artificial Sequence
  Description of Artificial Sequence: Synthetic peptide
GISADGSTDYIDSVKG

SEQ ID NO: 1146 - protein, 16 aa, Artificial Sequence
  Description of Artificial Sequence: Synthetic peptide
GISANGSTDYIDSVKG

SEQ ID NO: 1147 - protein, 16 aa, Artificial Sequence
  Description of Artificial Sequence: Synthetic peptide
GISANGSTTYIDSVKG

SEQ ID NO: 1148 - protein, 16 aa, Artificial Sequence
  Description of Artificial Sequence: Synthetic peptide
GISADGSTSYIDSVKG

SEQ ID NO: 1149 - protein, 16 aa, Artificial Sequence
  Description of Artificial Sequence: Synthetic peptide
GISADGSRDYIDSVKG

SEQ ID NO: 1150 - protein, 16 aa, Artificial Sequence
  Description of Artificial Sequence: Synthetic peptide
GISADGSTMYIDSVKG

SEQ ID NO: 1151 - protein, 16 aa, Artificial Sequence
  Description of Artificial Sequence: Synthetic peptide
GISPDGSTDYIDSVKG

SEQ ID NO: 1152 - protein, 16 aa, Artificial Sequence
  Description of Artificial Sequence: Synthetic peptide
GISGDGSTDYIDSVKG

SEQ ID NO: 1153 - protein, 16 aa, Artificial Sequence
  Description of Artificial Sequence: Synthetic peptide
GISRDGSTDYIDSVKG

SEQ ID NO: 1154 - protein, 16 aa, Artificial Sequence
  Description of Artificial Sequence: Synthetic peptide
GISRDGSTDYIDSVKG

SEQ ID NO: 1155 - protein, 16 aa, Artificial Sequence
  Description of Artificial Sequence: Synthetic peptide
GISRDGSTDYIDSVKG

SEQ ID NO: 1156 - protein, 16 aa, Artificial Sequence
  Description of Artificial Sequence: Synthetic peptide
GISADGSTDYIDSVKG

SEQ ID NO: 1157 - protein, 16 aa, Artificial Sequence
  Description of Artificial Sequence: Synthetic peptide
GISTDGSTDYIDSVKG

SEQ ID NO: 1158 - protein, 16 aa, Artificial Sequence
  Description of Artificial Sequence: Synthetic peptide
GISADGSTSYIDSVKG

SEQ ID NO: 1159 - protein, 16 aa, Artificial Sequence
  Description of Artificial Sequence: Synthetic peptide
GISADGSTLYIDSVKG

SEQ ID NO: 1160 - protein, 16 aa, Artificial Sequence
  Description of Artificial Sequence: Synthetic peptide
GISRDGSTDYIDSVKG

SEQ ID NO: 1161 - protein, 16 aa, Artificial Sequence
  Description of Artificial Sequence: Synthetic peptide
GISADGSTVYIDSVKG

SEQ ID NO: 1162 - protein, 16 aa, Artificial Sequence
  Description of Artificial Sequence: Synthetic peptide
GISTDGSTDYIDSVKG

SEQ ID NO: 1163 - protein, 16 aa, Artificial Sequence
  Description of Artificial Sequence: Synthetic peptide
GISADGSTLYIDSVKG

SEQ ID NO: 1164 - protein, 16 aa, Artificial Sequence
  Description of Artificial Sequence: Synthetic peptide
GISADGRTDYIDSVKG

SEQ ID NO: 1165 - protein, 16 aa, Artificial Sequence
  Description of Artificial Sequence: Synthetic peptide
GISADGSTIYIDSVKG

SEQ ID NO: 1166 - protein, 16 aa, Artificial Sequence
  Description of Artificial Sequence: Synthetic peptide
GISADGSTLYIDSVKG

SEQ ID NO: 1167 - protein, 16 aa, Artificial Sequence
  Description of Artificial Sequence: Synthetic peptide
GISRDGSTDYIDSVKG

SEQ ID NO: 1168 - protein, 16 aa, Artificial Sequence
  Description of Artificial Sequence: Synthetic peptide
GISKDGSTDYIDSVKG

SEQ ID NO: 1169 - protein, 16 aa, Artificial Sequence
  Description of Artificial Sequence: Synthetic peptide
GISADGSTDYIGSVKG

SEQ ID NO: 1170 - protein, 16 aa, Artificial Sequence
  Description of Artificial Sequence: Synthetic peptide
GISVDGSTDYIDSVKG

SEQ ID NO: 1171 - protein, 16 aa, Artificial Sequence
  Description of Artificial Sequence: Synthetic peptide
GISADGSTGYIDSVKG

SEQ ID NO: 1172 - protein, 16 aa, Artificial Sequence
  Description of Artificial Sequence: Synthetic peptide
GISGDGSTTYIDSVKG

SEQ ID NO: 1173 - protein, 16 aa, Artificial Sequence
  Description of Artificial Sequence: Synthetic peptide
GISTDGSTDYIDSVKG

SEQ ID NO: 1174 - protein, 16 aa, Artificial Sequence
  Description of Artificial Sequence: Synthetic peptide
GISADGSTDYFDSVKG

SEQ ID NO: 1175 - protein, 16 aa, Artificial Sequence
  Description of Artificial Sequence: Synthetic peptide
GISADGSTSYIDSVKG

SEQ ID NO: 1176 - protein, 16 aa, Artificial Sequence
  Description of Artificial Sequence: Synthetic peptide
GISADGSTDYIDSVKG

SEQ ID NO: 1177 - protein, 16 aa, Artificial Sequence
  Description of Artificial Sequence: Synthetic peptide
GISADGSTAYIDSVKG

SEQ ID NO: 1178 - protein, 16 aa, Artificial Sequence
  Description of Artificial Sequence: Synthetic peptide
GISADGSTVYIDSVKG

SEQ ID NO: 1179 - protein, 16 aa, Artificial Sequence
  Description of Artificial Sequence: Synthetic peptide
GISQDGSTDYIDSVKG

SEQ ID NO: 1180 - protein, 16 aa, Artificial Sequence
  Description of Artificial Sequence: Synthetic peptide
GISNDGSTDYIDSVKG

SEQ ID NO: 1181 - protein, 16 aa, Artificial Sequence
  Description of Artificial Sequence: Synthetic peptide
GISARGSTDYIDSVKG

SEQ ID NO: 1182 - protein, 16 aa, Artificial Sequence
  Description of Artificial Sequence: Synthetic peptide
GISADGSTDYIDSVKG

SEQ ID NO: 1183 - protein, 16 aa, Artificial Sequence
  Description of Artificial Sequence: Synthetic peptide
GISRDGSTDYIDSVKG

SEQ ID NO: 1184 - protein, 16 aa, Artificial Sequence
  Description of Artificial Sequence: Synthetic peptide
GISADGSTLYIDSVKG

SEQ ID NO: 1185 - protein, 16 aa, Artificial Sequence
  Description of Artificial Sequence: Synthetic peptide
GISADGSTNYIDSVKG

SEQ ID NO: 1186 - protein, 16 aa, Artificial Sequence
  Description of Artificial Sequence: Synthetic peptide
GISADGSTVYIDSVKG

SEQ ID NO: 1187 - protein, 16 aa, Artificial Sequence
  Description of Artificial Sequence: Synthetic peptide
GISADGSTTYIDSVKG

SEQ ID NO: 1188 - protein, 16 aa, Artificial Sequence
  Description of Artificial Sequence: Synthetic peptide
GISADGSTDYIGSVKG

SEQ ID NO: 1189 - protein, 16 aa, Artificial Sequence
  Description of Artificial Sequence: Synthetic peptide
GISRDGSTDYIDSVKG

SEQ ID NO: 1190 - protein, 16 aa, Artificial Sequence
  Description of Artificial Sequence: Synthetic peptide
GISADGSTTYIDSVKG

SEQ ID NO: 1191 - protein, 16 aa, Artificial Sequence
  Description of Artificial Sequence: Synthetic peptide
GVSSDGSTDYIDSVKG

SEQ ID NO: 1192 - protein, 16 aa, Artificial Sequence
  Description of Artificial Sequence: Synthetic peptide
GISADGHTDYIDSVKG

SEQ ID NO: 1193 - protein, 16 aa, Artificial Sequence
  Description of Artificial Sequence: Synthetic peptide
GISADGSTDYFDSVKG

SEQ ID NO: 1194 - protein, 16 aa, Artificial Sequence
  Description of Artificial Sequence: Synthetic peptide
GISADGSTVYIDSVKG

SEQ ID NO: 1195 - protein, 16 aa, Artificial Sequence
  Description of Artificial Sequence: Synthetic peptide
GISADGSTDYIASVKG

SEQ ID NO: 1196 - protein, 16 aa, Artificial Sequence
  Description of Artificial Sequence: Synthetic peptide
GISADGSTDYISSVKG

SEQ ID NO: 1197 - protein, 16 aa, Artificial Sequence
  Description of Artificial Sequence: Synthetic peptide
GISADGSTVYIDSVKG

SEQ ID NO: 1198 - protein, 16 aa, Artificial Sequence
  Description of Artificial Sequence: Synthetic peptide
GISADGSTVYIDSVKG

SEQ ID NO: 1199 - protein, 16 aa, Artificial Sequence
  Description of Artificial Sequence: Synthetic peptide
GISADGSTTYIDSVKG

SEQ ID NO: 1200 - protein, 16 aa, Artificial Sequence
  Description of Artificial Sequence: Synthetic peptide
GISVDGSTDYIDSVKG

SEQ ID NO: 1201 - protein, 16 aa, Artificial Sequence
  Description of Artificial Sequence: Synthetic peptide
GISADGSTAYIDSVKG

SEQ ID NO: 1202 - protein, 16 aa, Artificial Sequence
  Description of Artificial Sequence: Synthetic peptide
GISADGSTAYIDSVKG

SEQ ID NO: 1203 - protein, 16 aa, Artificial Sequence
  Description of Artificial Sequence: Synthetic peptide
GISADGSKDYIDSVKG

SEQ ID NO: 1204 - protein, 16 aa, Artificial Sequence
  Description of Artificial Sequence: Synthetic peptide
GISADGSTDYFDSVKG

SEQ ID NO: 1205 - protein, 16 aa, Artificial Sequence
  Description of Artificial Sequence: Synthetic peptide
GISADGSTDYIDSVKG

SEQ ID NO: 1206 - protein, 16 aa, Artificial Sequence
  Description of Artificial Sequence: Synthetic peptide
GISADGSTVYIDSVKG

SEQ ID NO: 1207 - protein, 16 aa, Artificial Sequence
  Description of Artificial Sequence: Synthetic peptide
GISADGSTVYIDSVKG

SEQ ID NO: 1208 - protein, 16 aa, Artificial Sequence
  Description of Artificial Sequence: Synthetic peptide
GISARGSTDYIDSVKG

SEQ ID NO: 1209 - protein, 16 aa, Artificial Sequence
  Description of Artificial Sequence: Synthetic peptide
GISATGSTDYIDSVKG

SEQ ID NO: 1210 - protein, 16 aa, Artificial Sequence
  Description of Artificial Sequence: Synthetic peptide
GISKDGSTDYIDSVKG

SEQ ID NO: 1211 - protein, 16 aa, Artificial Sequence
  Description of Artificial Sequence: Synthetic peptide
GISADGSTVYIDSVKG

SEQ ID NO: 1212 - protein, 16 aa, Artificial Sequence
  Description of Artificial Sequence: Synthetic peptide
GISPDGSTDYIDSVKG

SEQ ID NO: 1213 - protein, 16 aa, Artificial Sequence
  Description of Artificial Sequence: Synthetic peptide
GISADGSTHYIDSVKG

SEQ ID NO: 1214 - protein, 16 aa, Artificial Sequence
  Description of Artificial Sequence: Synthetic peptide
GISADGSTDYILSVKG

SEQ ID NO: 1215 - protein, 16 aa, Artificial Sequence
  Description of Artificial Sequence: Synthetic peptide
GISADGSTDYIHSVKG

SEQ ID NO: 1216 - protein, 16 aa, Artificial Sequence
  Description of Artificial Sequence: Synthetic peptide
GISVDGSTDYIDSVKG

SEQ ID NO: 1217 - protein, 16 aa, Artificial Sequence
  Description of Artificial Sequence: Synthetic peptide
GISRDGSTDYIDSVKG

SEQ ID NO: 1218 - protein, 16 aa, Artificial Sequence
  Description of Artificial Sequence: Synthetic peptide
GISADGSTVYIDSVKG

SEQ ID NO: 1219 - protein, 16 aa, Artificial Sequence
  Description of Artificial Sequence: Synthetic peptide
GISADGSTDYIRSVKG

SEQ ID NO: 1220 - protein, 16 aa, Artificial Sequence
  Description of Artificial Sequence: Synthetic peptide
GISADGSTMYIDSVKG

SEQ ID NO: 1221 - protein, 16 aa, Artificial Sequence
  Description of Artificial Sequence: Synthetic peptide
GISTDGSTDYIDSVKG

SEQ ID NO: 1222 - protein, 16 aa, Artificial Sequence
  Description of Artificial Sequence: Synthetic peptide
GISADGSTLYIDSVKG

SEQ ID NO: 1223 - protein, 16 aa, Artificial Sequence
  Description of Artificial Sequence: Synthetic peptide
GISADGSTDYIDSVKG

SEQ ID NO: 1224 - protein, 16 aa, Artificial Sequence
  Description of Artificial Sequence: Synthetic peptide
GISATGSTDYIDSVKG

SEQ ID NO: 1225 - protein, 16 aa, Artificial Sequence
  Description of Artificial Sequence: Synthetic peptide
GISHDGSTDYIDSVKG

SEQ ID NO: 1226 - protein, 16 aa, Artificial Sequence
  Description of Artificial Sequence: Synthetic peptide
GISYDGSTDYIDSVKG

SEQ ID NO: 1227 - protein, 16 aa, Artificial Sequence
  Description of Artificial Sequence: Synthetic peptide
GISTDGSTDYIDSVKG

SEQ ID NO: 1228 - protein, 16 aa, Artificial Sequence
  Description of Artificial Sequence: Synthetic peptide
GISADGSTAYIDSVKG

SEQ ID NO: 1229 - protein, 16 aa, Artificial Sequence
  Description of Artificial Sequence: Synthetic peptide
GISADGSTDYIESVKG

SEQ ID NO: 1230 - protein, 16 aa, Artificial Sequence
  Description of Artificial Sequence: Synthetic peptide
GISIDGSTDYIKSVKG

SEQ ID NO: 1231 - protein, 16 aa, Artificial Sequence
  Description of Artificial Sequence: Synthetic peptide
GISADGSKDYIDSVKG

SEQ ID NO: 1232 - protein, 16 aa, Artificial Sequence
  Description of Artificial Sequence: Synthetic peptide
GISADGSTVYIDSVKG

SEQ ID NO: 1233 - protein, 16 aa, Artificial Sequence
  Description of Artificial Sequence: Synthetic peptide
GISRDGSTDYIDSVKG

SEQ ID NO: 1234 - protein, 16 aa, Artificial Sequence
  Description of Artificial Sequence: Synthetic peptide
GISADGSTDYIHSVKG

SEQ ID NO: 1235 - protein, 16 aa, Artificial Sequence
  Description of Artificial Sequence: Synthetic peptide
GISADGSTIYIDSVKG

SEQ ID NO: 1236 - protein, 16 aa, Artificial Sequence
  Description of Artificial Sequence: Synthetic peptide
GISANGSTDYIDSVKG

SEQ ID NO: 1237 - protein, 16 aa, Artificial Sequence
  Description of Artificial Sequence: Synthetic peptide
GISTDGSTDYIDSVKG

SEQ ID NO: 1238 - protein, 16 aa, Artificial Sequence
  Description of Artificial Sequence: Synthetic peptide
GISYDGSTDYIDSVKG

SEQ ID NO: 1239 - protein, 16 aa, Artificial Sequence
  Description of Artificial Sequence: Synthetic peptide
GISADGSTDYIASVKG

SEQ ID NO: 1240 - protein, 16 aa, Artificial Sequence
  Description of Artificial Sequence: Synthetic peptide
GISADGSTDYIGSVKG

SEQ ID NO: 1241 - protein, 16 aa, Artificial Sequence
  Description of Artificial Sequence: Synthetic peptide
GISANGSTDYYDSVKG

SEQ ID NO: 1242 - protein, 16 aa, Artificial Sequence
  Description of Artificial Sequence: Synthetic peptide
GISADGSTSYIDSVKG

SEQ ID NO: 1243 - protein, 16 aa, Artificial Sequence
  Description of Artificial Sequence: Synthetic peptide
GVSADGSTDYIDSVKG

SEQ ID NO: 1244 - protein, 16 aa, Artificial Sequence
  Description of Artificial Sequence: Synthetic peptide
GISARGSTDYIDSVKG

SEQ ID NO: 1245 - protein, 16 aa, Artificial Sequence
  Description of Artificial Sequence: Synthetic peptide
GISADGSTIYIDSVKG

SEQ ID NO: 1246 - protein, 16 aa, Artificial Sequence
  Description of Artificial Sequence: Synthetic peptide
GISANGSTDYIDSVKG

SEQ ID NO: 1247 - protein, 16 aa, Artificial Sequence
  Description of Artificial Sequence: Synthetic peptide
GISADGSTDYVDSVKG

SEQ ID NO: 1248 - protein, 16 aa, Artificial Sequence
  Description of Artificial Sequence: Synthetic peptide
GISADGSTDYRDSVKG

SEQ ID NO: 1249 - protein, 16 aa, Artificial Sequence
  Description of Artificial Sequence: Synthetic peptide
GISVDGSTDYIDSVKG

SEQ ID NO: 1250 - protein, 16 aa, Artificial Sequence
  Description of Artificial Sequence: Synthetic peptide
GISADGSTDYILSVKG

SEQ ID NO: 1251 - protein, 16 aa, Artificial Sequence
  Description of Artificial Sequence: Synthetic peptide
GISVDGSTDYIDSVKG

SEQ ID NO: 1252 - protein, 16 aa, Artificial Sequence
  Description of Artificial Sequence: Synthetic peptide
GISSDGSKVFNESVKG

SEQ ID NO: 1253 - protein, 16 aa, Artificial Sequence
  Description of Artificial Sequence: Synthetic peptide
GISSDGSEVYTDSVKG

SEQ ID NO: 1254 - protein, 16 aa, Artificial Sequence
  Description of Artificial Sequence: Synthetic peptide
GISSDDSNVYYESVKG

SEQ ID NO: 1255 - protein, 16 aa, Artificial Sequence
  Description of Artificial Sequence: Synthetic peptide
GISSDGSKVYADSVKG

SEQ ID NO: 1256 - protein, 16 aa, Artificial Sequence
  Description of Artificial Sequence: Synthetic peptide
GISSDESTLYVDSVKG

SEQ ID NO: 1257 - protein, 16 aa, Artificial Sequence
  Description of Artificial Sequence: Synthetic peptide
GISSDDSKVYSDSVKG

SEQ ID NO: 1258 - protein, 16 aa, Artificial Sequence
  Description of Artificial Sequence: Synthetic peptide
GISSDGSQVYGASVKG

SEQ ID NO: 1259 - protein, 16 aa, Artificial Sequence
  Description of Artificial Sequence: Synthetic peptide
GISSDGSKVYADSVKG

SEQ ID NO: 1260 - protein, 16 aa, Artificial Sequence
  Description of Artificial Sequence: Synthetic peptide
GISSDGSNMYADSVKG

SEQ ID NO: 1261 - protein, 16 aa, Artificial Sequence
  Description of Artificial Sequence: Synthetic peptide
GISSDGSKVYTDSVKG

SEQ ID NO: 1262 - protein, 16 aa, Artificial Sequence
  Description of Artificial Sequence: Synthetic peptide
GISSDGSKVSAESVKG

SEQ ID NO: 1263 - protein, 16 aa, Artificial Sequence
  Description of Artificial Sequence: Synthetic peptide
GISSDGSKVYDDSVKG

SEQ ID NO: 1264 - protein, 16 aa, Artificial Sequence
  Description of Artificial Sequence: Synthetic peptide
GISSDGSKVYDDSVKG

SEQ ID NO: 1265 - protein, 16 aa, Artificial Sequence
  Description of Artificial Sequence: Synthetic peptide
GISSDGSAVYVGSVKG

SEQ ID NO: 1266 - protein, 16 aa, Artificial Sequence
  Description of Artificial Sequence: Synthetic peptide
GISSDGSYVYSESVKG

SEQ ID NO: 1267 - protein, 16 aa, Artificial Sequence
  Description of Artificial Sequence: Synthetic peptide
GISSDSSHVYADSVKG

SEQ ID NO: 1268 - protein, 16 aa, Artificial Sequence
  Description of Artificial Sequence: Synthetic peptide
GISSDSSIVYTDSVKG

SEQ ID NO: 1269 - protein, 16 aa, Artificial Sequence
  Description of Artificial Sequence: Synthetic peptide
GISSDGSEVNTDSVKG

SEQ ID NO: 1270 - protein, 16 aa, Artificial Sequence
  Description of Artificial Sequence: Synthetic peptide
GISSDGSKLSSDSVKG

SEQ ID NO: 1271 - protein, 16 aa, Artificial Sequence
  Description of Artificial Sequence: Synthetic peptide
GISSDNSKVYADSVKG

SEQ ID NO: 1272 - protein, 16 aa, Artificial Sequence
  Description of Artificial Sequence: Synthetic peptide
GISSDGSRVYFDSVKG

SEQ ID NO: 1273 - protein, 16 aa, Artificial Sequence
  Description of Artificial Sequence: Synthetic peptide
GISSDGSLVYAESVKG

SEQ ID NO: 1274 - protein, 16 aa, Artificial Sequence
  Description of Artificial Sequence: Synthetic peptide
GISSDGSVVYVDSVKG

SEQ ID NO: 1275 - protein, 16 aa, Artificial Sequence
  Description of Artificial Sequence: Synthetic peptide
GISSDGSKVYVDSVKG

SEQ ID NO: 1276 - protein, 16 aa, Artificial Sequence
  Description of Artificial Sequence: Synthetic peptide
GISSDGSKLYDESVKG

SEQ ID NO: 1277 - protein, 16 aa, Artificial Sequence
  Description of Artificial Sequence: Synthetic peptide
GISSDYSKLYADSVKG

SEQ ID NO: 1278 - protein, 16 aa, Artificial Sequence
  Description of Artificial Sequence: Synthetic peptide
GISSDSSKVYTESVKG

SEQ ID NO: 1279 - protein, 16 aa, Artificial Sequence
  Description of Artificial Sequence: Synthetic peptide
GISSDGSQVYVDSVKG

SEQ ID NO: 1280 - protein, 16 aa, Artificial Sequence
  Description of Artificial Sequence: Synthetic peptide
GISSDGSKVYSDSVKG

SEQ ID NO: 1281 - protein, 16 aa, Artificial Sequence
  Description of Artificial Sequence: Synthetic peptide
GISSDGSKVYVDSVKG

SEQ ID NO: 1282 - protein, 16 aa, Artificial Sequence
  Description of Artificial Sequence: Synthetic peptide
GISSDGSKVYADSVKG

SEQ ID NO: 1283 - protein, 16 aa, Artificial Sequence
  Description of Artificial Sequence: Synthetic peptide
GISSDGSSVYADSVKG

SEQ ID NO: 1284 - protein, 16 aa, Artificial Sequence
  Description of Artificial Sequence: Synthetic peptide
GISSDGSQVYYGSVKG

SEQ ID NO: 1285 - protein, 16 aa, Artificial Sequence
  Description of Artificial Sequence: Synthetic peptide
GISSDGSKVYTDSVKG

SEQ ID NO: 1286 - protein, 16 aa, Artificial Sequence
  Description of Artificial Sequence: Synthetic peptide
GISSDGSKVSADSVKG

SEQ ID NO: 1287 - protein, 16 aa, Artificial Sequence
  Description of Artificial Sequence: Synthetic peptide
GISSDGSKVYEDSVKG

SEQ ID NO: 1288 - protein, 16 aa, Artificial Sequence
  Description of Artificial Sequence: Synthetic peptide
GISSDRSKVYADSVKG

SEQ ID NO: 1289 - protein, 16 aa, Artificial Sequence
  Description of Artificial Sequence: Synthetic peptide
GISSDGSKVYAESVKG

SEQ ID NO: 1290 - protein, 16 aa, Artificial Sequence
  Description of Artificial Sequence: Synthetic peptide
GISSDGSVVTTESVKG

SEQ ID NO: 1291 - protein, 16 aa, Artificial Sequence
  Description of Artificial Sequence: Synthetic peptide
GISSDGSHVHQESVKG

SEQ ID NO: 1292 - protein, 16 aa, Artificial Sequence
  Description of Artificial Sequence: Synthetic peptide
GISADGSTVYVESVKG

SEQ ID NO: 1293 - protein, 16 aa, Artificial Sequence
  Description of Artificial Sequence: Synthetic peptide
GISSDGSTVYIDSVKG

SEQ ID NO: 1294 - protein, 16 aa, Artificial Sequence
  Description of Artificial Sequence: Synthetic peptide
GISVDGSTHYVASVKG

SEQ ID NO: 1295 - protein, 16 aa, Artificial Sequence
  Description of Artificial Sequence: Synthetic peptide
GISTDGSKHYIDSVKG

SEQ ID NO: 1296 - protein, 16 aa, Artificial Sequence
  Description of Artificial Sequence: Synthetic peptide
GISYDGSKYYAESVKG

SEQ ID NO: 1297 - protein, 16 aa, Artificial Sequence
  Description of Artificial Sequence: Synthetic peptide
GISANGSRTYMESVKG

SEQ ID NO: 1298 - protein, 16 aa, Artificial Sequence
  Description of Artificial Sequence: Synthetic peptide
GISPDGSTDYVDSVKG

SEQ ID NO: 1299 - protein, 16 aa, Artificial Sequence
  Description of Artificial Sequence: Synthetic peptide
GISPNGSAVYTESVKG

SEQ ID NO: 1300 - protein, 16 aa, Artificial Sequence
  Description of Artificial Sequence: Synthetic peptide
GISPDGSTAYMESVKG

SEQ ID NO: 1301 - protein, 16 aa, Artificial Sequence
  Description of Artificial Sequence: Synthetic peptide
GISNDGSTDYIDSVKG

SEQ ID NO: 1302 - protein, 16 aa, Artificial Sequence
  Description of Artificial Sequence: Synthetic peptide
GISTDGSAVYFDSVKG

SEQ ID NO: 1303 - protein, 16 aa, Artificial Sequence
  Description of Artificial Sequence: Synthetic peptide
GISTGGSTHYIESVKG

SEQ ID NO: 1304 - protein, 16 aa, Artificial Sequence
  Description of Artificial Sequence: Synthetic peptide
GISTDGSTVYIDSVKG

SEQ ID NO: 1305 - protein, 16 aa, Artificial Sequence
  Description of Artificial Sequence: Synthetic peptide
GISNEGSTYYMDSVKG

SEQ ID NO: 1306 - protein, 16 aa, Artificial Sequence
  Description of Artificial Sequence: Synthetic peptide
GISADGSHVYTNSVKG

SEQ ID NO: 1307 - protein, 16 aa, Artificial Sequence
  Description of Artificial Sequence: Synthetic peptide
GISDDGSRYYTDSVKG

SEQ ID NO: 1308 - protein, 16 aa, Artificial Sequence
  Description of Artificial Sequence: Synthetic peptide
GISAEGSTLYMESVKG

SEQ ID NO: 1309 - protein, 16 aa, Artificial Sequence
  Description of Artificial Sequence: Synthetic peptide
GISTDGSTVYIDSVKG

SEQ ID NO: 1310 - protein, 16 aa, Artificial Sequence
  Description of Artificial Sequence: Synthetic peptide
GISANGSTSYIDSVKG

SEQ ID NO: 1311 - protein, 16 aa, Artificial Sequence
  Description of Artificial Sequence: Synthetic peptide
GISDDGSRHYIESVKG

SEQ ID NO: 1312 - protein, 16 aa, Artificial Sequence
  Description of Artificial Sequence: Synthetic peptide
GISPDGSTVYIESVKG

SEQ ID NO: 1313 - protein, 16 aa, Artificial Sequence
  Description of Artificial Sequence: Synthetic peptide
GISDDGSTVYVDSVKG

SEQ ID NO: 1314 - protein, 16 aa, Artificial Sequence
  Description of Artificial Sequence: Synthetic peptide
GISDDGSTVYFDSVKG

SEQ ID NO: 1315 - protein, 16 aa, Artificial Sequence
  Description of Artificial Sequence: Synthetic peptide
GISDEGSTVYIGSVKG

SEQ ID NO: 1316 - protein, 16 aa, Artificial Sequence
  Description of Artificial Sequence: Synthetic peptide
GISDDGSIVYMDSVKG

SEQ ID NO: 1317 - protein, 16 aa, Artificial Sequence
  Description of Artificial Sequence: Synthetic peptide
GISDDGSKHYFDSVKG

SEQ ID NO: 1318 - protein, 16 aa, Artificial Sequence
  Description of Artificial Sequence: Synthetic peptide
GISTDGSTDYLHSVKG

SEQ ID NO: 1319 - protein, 16 aa, Artificial Sequence
  Description of Artificial Sequence: Synthetic peptide
GISDDGSKHYFDSVKG

SEQ ID NO: 1320 - protein, 16 aa, Artificial Sequence
  Description of Artificial Sequence: Synthetic peptide
GISYDGSTVYVESVKG

SEQ ID NO: 1321 - protein, 16 aa, Artificial Sequence
  Description of Artificial Sequence: Synthetic peptide
GISDDGSTVYIDSVKG

SEQ ID NO: 1322 - protein, 16 aa, Artificial Sequence
  Description of Artificial Sequence: Synthetic peptide
GISDDGSTVYVDSVKG

SEQ ID NO: 1323 - protein, 16 aa, Artificial Sequence
  Description of Artificial Sequence: Synthetic peptide
GISDDGSQVYIDSVKG

SEQ ID NO: 1324 - protein, 16 aa, Artificial Sequence
  Description of Artificial Sequence: Synthetic peptide
GISVDGSTVYSDSVKG

SEQ ID NO: 1325 - protein, 16 aa, Artificial Sequence
  Description of Artificial Sequence: Synthetic peptide
GISDDGSNVYIDSVKG

SEQ ID NO: 1326 - protein, 16 aa, Artificial Sequence
  Description of Artificial Sequence: Synthetic peptide
GISTDGSTVYFVSVKG

SEQ ID NO: 1327 - protein, 7 aa, Artificial Sequence
  Description of Artificial Sequence: Synthetic peptide
RYFERTD

SEQ ID NO: 1328 - protein, 7 aa, Artificial Sequence
  Description of Artificial Sequence: Synthetic peptide
RYFERTD

SEQ ID NO: 1329 - protein, 7 aa, Artificial Sequence
  Description of Artificial Sequence: Synthetic peptide
RYFERTD

SEQ ID NO: 1330 - protein, 7 aa, Artificial Sequence
  Description of Artificial Sequence: Synthetic peptide
YQGLYAY

SEQ ID NO: 1331 - protein, 7 aa, Artificial Sequence
  Description of Artificial Sequence: Synthetic peptide
RVFDHVY

SEQ ID NO: 1332 - protein, 7 aa, Artificial Sequence
  Description of Artificial Sequence: Synthetic peptide
RAFGRDY

SEQ ID NO: 1333 - protein, 7 aa, Artificial Sequence
  Description of Artificial Sequence: Synthetic peptide
RTMGRDY

SEQ ID NO: 1334 - protein, 8 aa, Artificial Sequence
  Description of Artificial Sequence: Synthetic peptide
WDGVGGAY

SEQ ID NO: 1335 - protein, 8 aa, Artificial Sequence
  Description of Artificial Sequence: Synthetic peptide
WDGVGGAY

SEQ ID NO: 1336 - protein, 8 aa, Artificial Sequence
  Description of Artificial Sequence: Synthetic peptide
WNGVGGAY

SEQ ID NO: 1337 - protein, 8 aa, Artificial Sequence
  Description of Artificial Sequence: Synthetic peptide
WDGVGGAY

SEQ ID NO: 1338 - protein, 8 aa, Artificial Sequence
  Description of Artificial Sequence: Synthetic peptide
WDGVGGAY

SEQ ID NO: 1339 - protein, 6 aa, Artificial Sequence
  Description of Artificial Sequence: Synthetic peptide
RSWNNY

SEQ ID NO: 1340 - protein, 6 aa, Artificial Sequence
  Description of Artificial Sequence: Synthetic peptide
RSWNNY

SEQ ID NO: 1341 - protein, 6 aa, Artificial Sequence
  Description of Artificial Sequence: Synthetic peptide
RSWNNY

SEQ ID NO: 1342 - protein, 9 aa, Artificial Sequence
  Description of Artificial Sequence: Synthetic peptide
ESFGRIWYN

SEQ ID NO: 1343 - protein, 7 aa, Artificial Sequence
  Description of Artificial Sequence: Synthetic peptide
QHFGTDS

SEQ ID NO: 1344 - protein, 7 aa, Artificial Sequence
  Description of Artificial Sequence: Synthetic peptide
QQFGTDS

SEQ ID NO: 1345 - protein, 9 aa, Artificial Sequence
  Description of Artificial Sequence: Synthetic peptide
YGIQRAEGY

SEQ ID NO: 1346 - protein, 9 aa, Artificial Sequence
  Description of Artificial Sequence: Synthetic peptide
YRWVGRDTY

SEQ ID NO: 1347 - protein, 9 aa, Artificial Sequence
  Description of Artificial Sequence: Synthetic peptide
YRWVGRDTY

SEQ ID NO: 1348 - protein, 9 aa, Artificial Sequence
  Description of Artificial Sequence: Synthetic peptide
YRWVGRDTY

SEQ ID NO: 1349 - protein, 9 aa, Artificial Sequence
  Description of Artificial Sequence: Synthetic peptide
YRWEGRDTY

SEQ ID NO: 1350 - protein, 9 aa, Artificial Sequence
  Description of Artificial Sequence: Synthetic peptide
YRWEGRNTY

SEQ ID NO: 1351 - protein, 9 aa, Artificial Sequence
  Description of Artificial Sequence: Synthetic peptide
YRWVGRYTY

SEQ ID NO: 1352 - protein, 9 aa, Artificial Sequence
  Description of Artificial Sequence: Synthetic peptide
YRWVGRDTY

SEQ ID NO: 1353 - protein, 9 aa, Artificial Sequence
  Description of Artificial Sequence: Synthetic peptide
YRWVGRDTY

SEQ ID NO: 1354 - protein, 9 aa, Artificial Sequence
  Description of Artificial Sequence: Synthetic peptide
YRWVGRDTY

SEQ ID NO: 1355 - protein, 9 aa, Artificial Sequence
  Description of Artificial Sequence: Synthetic peptide
YRWVDRYTY

SEQ ID NO: 1356 - protein, 9 aa, Artificial Sequence
  Description of Artificial Sequence: Synthetic peptide
YRWIDRYTY

SEQ ID NO: 1357 - protein, 9 aa, Artificial Sequence
  Description of Artificial Sequence: Synthetic peptide
YRWVDRYTY

SEQ ID NO: 1358 - protein, 9 aa, Artificial Sequence
  Description of Artificial Sequence: Synthetic peptide
YRWVGRDTY

SEQ ID NO: 1359 - protein, 9 aa, Artificial Sequence
  Description of Artificial Sequence: Synthetic peptide
YRWTTRYTY

SEQ ID NO: 1360 - protein, 9 aa, Artificial Sequence
  Description of Artificial Sequence: Synthetic peptide
YRWVGGYTY

SEQ ID NO: 1361 - protein, 11 aa, Artificial Sequence
  Description of Artificial Sequence: Synthetic peptide
FRTVAASSMQY

SEQ ID NO: 1362 - protein, 11 aa, Artificial Sequence
  Description of Artificial Sequence: Synthetic peptide
FRTVSGSSMRY

SEQ ID NO: 1363 - protein, 10 aa, Artificial Sequence
  Description of Artificial Sequence: Synthetic peptide
NRGFAGAPSY

SEQ ID NO: 1364 - protein, 6 aa, Artificial Sequence
  Description of Artificial Sequence: Synthetic peptide
YFQSSY

SEQ ID NO: 1365 - protein, 6 aa, Artificial Sequence
  Description of Artificial Sequence: Synthetic peptide
YFQSSY

SEQ ID NO: 1366 - protein, 6 aa, Artificial Sequence
  Description of Artificial Sequence: Synthetic peptide
YFQSSY

SEQ ID NO: 1367 - protein, 11 aa, Artificial Sequence
  Description of Artificial Sequence: Synthetic peptide
HWTQGSVPKES

SEQ ID NO: 1368 - protein, 7 aa, Artificial Sequence
  Description of Artificial Sequence: Synthetic peptide
RSYSSDY

SEQ ID NO: 1369 - protein, 7 aa, Artificial Sequence
  Description of Artificial Sequence: Synthetic peptide
RYGDINY

SEQ ID NO: 1370 - protein, 7 aa, Artificial Sequence
  Description of Artificial Sequence: Synthetic peptide
RYGDINY

SEQ ID NO: 1371 - protein, 6 aa, Artificial Sequence
  Description of Artificial Sequence: Synthetic peptide
YDSRSY

SEQ ID NO: 1372 - protein, 7 aa, Artificial Sequence
  Description of Artificial Sequence: Synthetic peptide
YDNINAY

SEQ ID NO: 1373 - protein, 7 aa, Artificial Sequence
  Description of Artificial Sequence: Synthetic peptide
YDNINAY

SEQ ID NO: 1374 - protein, 7 aa, Artificial Sequence
  Description of Artificial Sequence: Synthetic peptide
YDNINAY

SEQ ID NO: 1375 - protein, 7 aa, Artificial Sequence
  Description of Artificial Sequence: Synthetic peptide
YDNINAY

SEQ ID NO: 1376 - protein, 7 aa, Artificial Sequence
  Description of Artificial Sequence: Synthetic peptide
WIAGKAY

SEQ ID NO: 1377 - protein, 7 aa, Artificial Sequence
  Description of Artificial Sequence: Synthetic peptide
RSQLGST

SEQ ID NO: 1378 - protein, 8 aa, Artificial Sequence
  Description of Artificial Sequence: Synthetic peptide
YYLDTYAY

SEQ ID NO: 1379 - protein, 7 aa, Artificial Sequence
  Description of Artificial Sequence: Synthetic peptide
RYFERTD

SEQ ID NO: 1380 - protein, 6 aa, Artificial Sequence
  Description of Artificial Sequence: Synthetic peptide
YFQSSY

SEQ ID NO: 1381 - protein, 9 aa, Artificial Sequence
  Description of Artificial Sequence: Synthetic peptide
YRWVGRDTY

SEQ ID NO: 1382 - protein, 7 aa, Artificial Sequence
  Description of Artificial Sequence: Synthetic peptide
WIAGKAY

SEQ ID NO: 1383 - protein, 8 aa, Artificial Sequence
  Description of Artificial Sequence: Synthetic peptide
WNGVGGAY

SEQ ID NO: 1384 - protein, 8 aa, Artificial Sequence
  Description of Artificial Sequence: Synthetic peptide
WDGVGGAY

SEQ ID NO: 1385 - protein, 7 aa, Artificial Sequence
  Description of Artificial Sequence: Synthetic peptide
RAFGRDY

SEQ ID NO: 1386 - protein, 11 aa, Artificial Sequence
  Description of Artificial Sequence: Synthetic peptide
FRTVAASSMQY

SEQ ID NO: 1387 - protein, 6 aa, Artificial Sequence
  Description of Artificial Sequence: Synthetic peptide
RSWNNY

SEQ ID NO: 1388 - protein, 6 aa, Artificial Sequence
  Description of Artificial Sequence: Synthetic peptide
YFQSSY

SEQ ID NO: 1389 - protein, 7 aa, Artificial Sequence
  Description of Artificial Sequence: Synthetic peptide
QHFGTDS

SEQ ID NO: 1390 - protein, 7 aa, Artificial Sequence
  Description of Artificial Sequence: Synthetic peptide
RSQLGST

SEQ ID NO: 1391 - protein, 7 aa, Artificial Sequence
  Description of Artificial Sequence: Synthetic peptide
YQGLYAY

SEQ ID NO: 1392 - protein, 7 aa, Artificial Sequence
  Description of Artificial Sequence: Synthetic peptide
YDNINAY

SEQ ID NO: 1393 - protein, 11 aa, Artificial Sequence
  Description of Artificial Sequence: Synthetic peptide
HWTQGSVPKES

SEQ ID NO: 1394 - protein, 11 aa, Artificial Sequence
  Description of Artificial Sequence: Synthetic peptide
FRTVSGSSMRY

SEQ ID NO: 1395 - protein, 7 aa, Artificial Sequence
  Description of Artificial Sequence: Synthetic peptide
RSYSSDY

SEQ ID NO: 1396 - protein, 6 aa, Artificial Sequence
  Description of Artificial Sequence: Synthetic peptide
RSWNNY

SEQ ID NO: 1397 - protein, 7 aa, Artificial Sequence
  Description of Artificial Sequence: Synthetic peptide
QQFGTDS

SEQ ID NO: 1398 - protein, 9 aa, Artificial Sequence
  Description of Artificial Sequence: Synthetic peptide
YGIQRAEGY

SEQ ID NO: 1399 - protein, 9 aa, Artificial Sequence
  Description of Artificial Sequence: Synthetic peptide
YRWVGRYTY

SEQ ID NO: 1400 - protein, 7 aa, Artificial Sequence
  Description of Artificial Sequence: Synthetic peptide
RYGDINY

SEQ ID NO: 1401 - protein, 9 aa, Artificial Sequence
  Description of Artificial Sequence: Synthetic peptide
YRWTTRYTY

SEQ ID NO: 1402 - protein, 8 aa, Artificial Sequence
  Description of Artificial Sequence: Synthetic peptide
YYLDTYAY

SEQ ID NO: 1403 - protein, 9 aa, Artificial Sequence
  Description of Artificial Sequence: Synthetic peptide
YRWEGRNTY

SEQ ID NO: 1404 - protein, 9 aa, Artificial Sequence
  Description of Artificial Sequence: Synthetic peptide
ESFGRIWYN

SEQ ID NO: 1405 - protein, 7 aa, Artificial Sequence
  Description of Artificial Sequence: Synthetic peptide
RYGDINY

SEQ ID NO: 1406 - protein, 7 aa, Artificial Sequence
  Description of Artificial Sequence: Synthetic peptide
RVFDHVY

SEQ ID NO: 1407 - protein, 6 aa, Artificial Sequence
  Description of Artificial Sequence: Synthetic peptide
YFQSSY

SEQ ID NO: 1408 - protein, 8 aa, Artificial Sequence
  Description of Artificial Sequence: Synthetic peptide
WDGVGGAY

SEQ ID NO: 1409 - protein, 9 aa, Artificial Sequence
  Description of Artificial Sequence: Synthetic peptide
YRWVGGYTY

SEQ ID NO: 1410 - protein, 6 aa, Artificial Sequence
  Description of Artificial Sequence: Synthetic peptide
YDSRSY

SEQ ID NO: 1411 - protein, 10 aa, Artificial Sequence
  Description of Artificial Sequence: Synthetic peptide
NRGFAGAPSY

SEQ ID NO: 1412 - protein, 7 aa, Artificial Sequence
  Description of Artificial Sequence: Synthetic peptide
RTMGRDY

SEQ ID NO: 1413 - protein, 11 aa, Artificial Sequence
  Description of Artificial Sequence: Synthetic peptide
FRHVSGSSMRY

SEQ ID NO: 1414 - protein, 11 aa, Artificial Sequence
  Description of Artificial Sequence: Synthetic peptide
FRTVSGSSSRY

SEQ ID NO: 1415 - protein, 11 aa, Artificial Sequence
  Description of Artificial Sequence: Synthetic peptide
FRTVSGSSMRY

SEQ ID NO: 1416 - protein, 11 aa, Artificial Sequence
  Description of Artificial Sequence: Synthetic peptide
FRTVRGSSMSY

SEQ ID NO: 1417 - protein, 11 aa, Artificial Sequence
  Description of Artificial Sequence: Synthetic peptide
FRTVSGSSKRY

SEQ ID NO: 1418 - protein, 11 aa, Artificial Sequence
  Description of Artificial Sequence: Synthetic peptide
FRMVSGSSMRY

SEQ ID NO: 1419 - protein, 11 aa, Artificial Sequence
  Description of Artificial Sequence: Synthetic peptide
FRTVQGSSMRY

SEQ ID NO: 1420 - protein, 11 aa, Artificial Sequence
  Description of Artificial Sequence: Synthetic peptide
FRTVYGSSMRY

SEQ ID NO: 1421 - protein, 11 aa, Artificial Sequence
  Description of Artificial Sequence: Synthetic peptide
FRTVSGSSYRY

SEQ ID NO: 1422 - protein, 11 aa, Artificial Sequence
  Description of Artificial Sequence: Synthetic peptide
FRTVLGSSMRY

SEQ ID NO: 1423 - protein, 11 aa, Artificial Sequence
  Description of Artificial Sequence: Synthetic peptide
FRRVSGSSMRY

SEQ ID NO: 1424 - protein, 11 aa, Artificial Sequence
  Description of Artificial Sequence: Synthetic peptide
FRTVSGSSMRY

SEQ ID NO: 1425 - protein, 11 aa, Artificial Sequence
  Description of Artificial Sequence: Synthetic peptide
FRTVSGSSARY

SEQ ID NO: 1426 - protein, 11 aa, Artificial Sequence
  Description of Artificial Sequence: Synthetic peptide
FRIVRGSSMRY

SEQ ID NO: 1427 - protein, 11 aa, Artificial Sequence
  Description of Artificial Sequence: Synthetic peptide
YRTVSGSSMRY

SEQ ID NO: 1428 - protein, 11 aa, Artificial Sequence
  Description of Artificial Sequence: Synthetic peptide
FRHVSGSSMRY

SEQ ID NO: 1429 - protein, 11 aa, Artificial Sequence
  Description of Artificial Sequence: Synthetic peptide
FRFVSGSSMRY

SEQ ID NO: 1430 - protein, 11 aa, Artificial Sequence
  Description of Artificial Sequence: Synthetic peptide
FRTVSGSSMRY

SEQ ID NO: 1431 - protein, 11 aa, Artificial Sequence
  Description of Artificial Sequence: Synthetic peptide
FRTKSGSSMRY

SEQ ID NO: 1432 - protein, 11 aa, Artificial Sequence
  Description of Artificial Sequence: Synthetic peptide
FRTVYGSSMRY

SEQ ID NO: 1433 - protein, 11 aa, Artificial Sequence
  Description of Artificial Sequence: Synthetic peptide
FRTVSGSSMGY

SEQ ID NO: 1434 - protein, 11 aa, Artificial Sequence
  Description of Artificial Sequence: Synthetic peptide
FRTVSGSSMRS

SEQ ID NO: 1435 - protein, 11 aa, Artificial Sequence
  Description of Artificial Sequence: Synthetic peptide
FRTVGGSSMRY

SEQ ID NO: 1436 - protein, 11 aa, Artificial Sequence
  Description of Artificial Sequence: Synthetic peptide
FRTVSGSSMRY

SEQ ID NO: 1437 - protein, 11 aa, Artificial Sequence
  Description of Artificial Sequence: Synthetic peptide
FRTVSGSHMRY

SEQ ID NO: 1438 - protein, 11 aa, Artificial Sequence
  Description of Artificial Sequence: Synthetic peptide
FRAVSGSSMRY

SEQ ID NO: 1439 - protein, 11 aa, Artificial Sequence
  Description of Artificial Sequence: Synthetic peptide
FRTVSGSSMRY

SEQ ID NO: 1440 - protein, 11 aa, Artificial Sequence
  Description of Artificial Sequence: Synthetic peptide
FRTVSGSPMRY

SEQ ID NO: 1441 - protein, 11 aa, Artificial Sequence
  Description of Artificial Sequence: Synthetic peptide
FRTVSGSSMSY

SEQ ID NO: 1442 - protein, 11 aa, Artificial Sequence
  Description of Artificial Sequence: Synthetic peptide
FRTVSGSSMRY

SEQ ID NO: 1443 - protein, 11 aa, Artificial Sequence
  Description of Artificial Sequence: Synthetic peptide
FRTVRGSSMRY

SEQ ID NO: 1444 - protein, 11 aa, Artificial Sequence
  Description of Artificial Sequence: Synthetic peptide
FRTVRGSSMRY

SEQ ID NO: 1445 - protein, 11 aa, Artificial Sequence
  Description of Artificial Sequence: Synthetic peptide
FRQVSGSSMRY

SEQ ID NO: 1446 - protein, 11 aa, Artificial Sequence
  Description of Artificial Sequence: Synthetic peptide
FRIVSGSSMGY

SEQ ID NO: 1447 - protein, 11 aa, Artificial Sequence
  Description of Artificial Sequence: Synthetic peptide
FRTVSGASMRY

SEQ ID NO: 1448 - protein, 11 aa, Artificial Sequence
  Description of Artificial Sequence: Synthetic peptide
FRTVHGSSMRY

SEQ ID NO: 1449 - protein, 11 aa, Artificial Sequence
  Description of Artificial Sequence: Synthetic peptide
FRMVSGSSMRY

SEQ ID NO: 1450 - protein, 11 aa, Artificial Sequence
  Description of Artificial Sequence: Synthetic peptide
FRTISGSSMRY

SEQ ID NO: 1451 - protein, 11 aa, Artificial Sequence
  Description of Artificial Sequence: Synthetic peptide
FRTRSGSSMRY

SEQ ID NO: 1452 - protein, 11 aa, Artificial Sequence
  Description of Artificial Sequence: Synthetic peptide
FRTVSGHSMRY

SEQ ID NO: 1453 - protein, 11 aa, Artificial Sequence
  Description of Artificial Sequence: Synthetic peptide
FRTVSGGSMRY

SEQ ID NO: 1454 - protein, 11 aa, Artificial Sequence
  Description of Artificial Sequence: Synthetic peptide
FRTKSGSSMRY

SEQ ID NO: 1455 - protein, 11 aa, Artificial Sequence
  Description of Artificial Sequence: Synthetic peptide
FRTASGTSMRY

SEQ ID NO: 1456 - protein, 11 aa, Artificial Sequence
  Description of Artificial Sequence: Synthetic peptide
FNTVSGSSMRY

SEQ ID NO: 1457 - protein, 11 aa, Artificial Sequence
  Description of Artificial Sequence: Synthetic peptide
FRTVRGSSQRY

SEQ ID NO: 1458 - protein, 11 aa, Artificial Sequence
  Description of Artificial Sequence: Synthetic peptide
FRTVLGSSMRY

SEQ ID NO: 1459 - protein, 11 aa, Artificial Sequence
  Description of Artificial Sequence: Synthetic peptide
FRTRSGSSMRY

SEQ ID NO: 1460 - protein, 11 aa, Artificial Sequence
  Description of Artificial Sequence: Synthetic peptide
FRTVSGLSMRY

SEQ ID NO: 1461 - protein, 11 aa, Artificial Sequence
  Description of Artificial Sequence: Synthetic peptide
FRTVRGSSQRY

SEQ ID NO: 1462 - protein, 11 aa, Artificial Sequence
  Description of Artificial Sequence: Synthetic peptide
FRTVSGSSMVY

SEQ ID NO: 1463 - protein, 11 aa, Artificial Sequence
  Description of Artificial Sequence: Synthetic peptide
FRTVSRSSMRY

SEQ ID NO: 1464 - protein, 11 aa, Artificial Sequence
  Description of Artificial Sequence: Synthetic peptide
FRTVSGSSMSY

SEQ ID NO: 1465 - protein, 11 aa, Artificial Sequence
  Description of Artificial Sequence: Synthetic peptide
FRTVSGSSARY

SEQ ID NO: 1466 - protein, 11 aa, Artificial Sequence
  Description of Artificial Sequence: Synthetic peptide
FHTVSGSSMRY

SEQ ID NO: 1467 - protein, 11 aa, Artificial Sequence
  Description of Artificial Sequence: Synthetic peptide
FRTVLGSSMRY

SEQ ID NO: 1468 - protein, 11 aa, Artificial Sequence
  Description of Artificial Sequence: Synthetic peptide
FRTVSGSSMRY

SEQ ID NO: 1469 - protein, 11 aa, Artificial Sequence
  Description of Artificial Sequence: Synthetic peptide
FRNVSGSSMRY

SEQ ID NO: 1470 - protein, 11 aa, Artificial Sequence
  Description of Artificial Sequence: Synthetic peptide
FRTVTGSSMRY

SEQ ID NO: 1471 - protein, 11 aa, Artificial Sequence
  Description of Artificial Sequence: Synthetic peptide
FRTVSGSSMRY

SEQ ID NO: 1472 - protein, 11 aa, Artificial Sequence
  Description of Artificial Sequence: Synthetic peptide
FRTVKGSSMRY

SEQ ID NO: 1473 - protein, 11 aa, Artificial Sequence
  Description of Artificial Sequence: Synthetic peptide
FRTNSGSSMRY

SEQ ID NO: 1474 - protein, 11 aa, Artificial Sequence
  Description of Artificial Sequence: Synthetic peptide
FRTVSGASMRY

SEQ ID NO: 1475 - protein, 11 aa, Artificial Sequence
  Description of Artificial Sequence: Synthetic peptide
FRTVNLSSMRY

SEQ ID NO: 1476 - protein, 11 aa, Artificial Sequence
  Description of Artificial Sequence: Synthetic peptide
FRTVTGSSMRY

SEQ ID NO: 1477 - protein, 11 aa, Artificial Sequence
  Description of Artificial Sequence: Synthetic peptide
FRKVSGSSARY

SEQ ID NO: 1478 - protein, 11 aa, Artificial Sequence
  Description of Artificial Sequence: Synthetic peptide
FRTYSGSSMRY

SEQ ID NO: 1479 - protein, 11 aa, Artificial Sequence
  Description of Artificial Sequence: Synthetic peptide
FRTVSKSSMRY

SEQ ID NO: 1480 - protein, 11 aa, Artificial Sequence
  Description of Artificial Sequence: Synthetic peptide
FKTVSGSSMRY

SEQ ID NO: 1481 - protein, 11 aa, Artificial Sequence
  Description of Artificial Sequence: Synthetic peptide
FRTRSGSSMRY

SEQ ID NO: 1482 - protein, 11 aa, Artificial Sequence
  Description of Artificial Sequence: Synthetic peptide
FRTSSGSSMRY

SEQ ID NO: 1483 - protein, 11 aa, Artificial Sequence
  Description of Artificial Sequence: Synthetic peptide
FRFLSGSSMRY

SEQ ID NO: 1484 - protein, 11 aa, Artificial Sequence
  Description of Artificial Sequence: Synthetic peptide
FRTVSGSSMRY

SEQ ID NO: 1485 - protein, 11 aa, Artificial Sequence
  Description of Artificial Sequence: Synthetic peptide
FRLVSGSSMRY

SEQ ID NO: 1486 - protein, 11 aa, Artificial Sequence
  Description of Artificial Sequence: Synthetic peptide
FRTVSGSSMRF

SEQ ID NO: 1487 - protein, 11 aa, Artificial Sequence
  Description of Artificial Sequence: Synthetic peptide
FRTQSGSSMRY

SEQ ID NO: 1488 - protein, 11 aa, Artificial Sequence
  Description of Artificial Sequence: Synthetic peptide
FRTVSGSSMPY

SEQ ID NO: 1489 - protein, 11 aa, Artificial Sequence
  Description of Artificial Sequence: Synthetic peptide
FRTLSGSSMRY

SEQ ID NO: 1490 - protein, 11 aa, Artificial Sequence
  Description of Artificial Sequence: Synthetic peptide
FRTVSGSAMRY

SEQ ID NO: 1491 - protein, 11 aa, Artificial Sequence
  Description of Artificial Sequence: Synthetic peptide
FRTTSGSSMRY

SEQ ID NO: 1492 - protein, 11 aa, Artificial Sequence
  Description of Artificial Sequence: Synthetic peptide
FRTVSGTSMRY

SEQ ID NO: 1493 - protein, 11 aa, Artificial Sequence
  Description of Artificial Sequence: Synthetic peptide
FRTRSGSSMRY

SEQ ID NO: 1494 - protein, 11 aa, Artificial Sequence
  Description of Artificial Sequence: Synthetic peptide
FRTSSGSSMRY

SEQ ID NO: 1495 - protein, 11 aa, Artificial Sequence
  Description of Artificial Sequence: Synthetic peptide
FRTVSGSSMSY

SEQ ID NO: 1496 - protein, 11 aa, Artificial Sequence
  Description of Artificial Sequence: Synthetic peptide
FRPVSGSSMRY

SEQ ID NO: 1497 - protein, 11 aa, Artificial Sequence
  Description of Artificial Sequence: Synthetic peptide
FRHVSGSSMRY

SEQ ID NO: 1498 - protein, 11 aa, Artificial Sequence
  Description of Artificial Sequence: Synthetic peptide
FRTKSGSSMRY

SEQ ID NO: 1499 - protein, 11 aa, Artificial Sequence
  Description of Artificial Sequence: Synthetic peptide
FTTVSGSSMRY

SEQ ID NO: 1500 - protein, 11 aa, Artificial Sequence
  Description of Artificial Sequence: Synthetic peptide
FHTVSGSSMRY

SEQ ID NO: 1501 - protein, 11 aa, Artificial Sequence
  Description of Artificial Sequence: Synthetic peptide
FRTVRGSSMRY

SEQ ID NO: 1502 - protein, 11 aa, Artificial Sequence
  Description of Artificial Sequence: Synthetic peptide
FRTVLGSSMRY

SEQ ID NO: 1503 - protein, 11 aa, Artificial Sequence
  Description of Artificial Sequence: Synthetic peptide
FRTVSGSSMRS

SEQ ID NO: 1504 - protein, 11 aa, Artificial Sequence
  Description of Artificial Sequence: Synthetic peptide
FRTVRGSSMRY

SEQ ID NO: 1505 - protein, 11 aa, Artificial Sequence
  Description of Artificial Sequence: Synthetic peptide
FRYVSGSSMRY

SEQ ID NO: 1506 - protein, 11 aa, Artificial Sequence
  Description of Artificial Sequence: Synthetic peptide
FRTVYGSSMRY

SEQ ID NO: 1507 - protein, 11 aa, Artificial Sequence
  Description of Artificial Sequence: Synthetic peptide
FRTVLGSSMRY

SEQ ID NO: 1508 - protein, 11 aa, Artificial Sequence
  Description of Artificial Sequence: Synthetic peptide
YRTVSGSSMRY

SEQ ID NO: 1509 - protein, 11 aa, Artificial Sequence
  Description of Artificial Sequence: Synthetic peptide
FRSVSGSSMRY

SEQ ID NO: 1510 - protein, 11 aa, Artificial Sequence
  Description of Artificial Sequence: Synthetic peptide
FRRVSGSSMRY

SEQ ID NO: 1511 - protein, 11 aa, Artificial Sequence
  Description of Artificial Sequence: Synthetic peptide
FRTVSGTSMRY

SEQ ID NO: 1512 - protein, 11 aa, Artificial Sequence
  Description of Artificial Sequence: Synthetic peptide
FRTVAGSSMRY

SEQ ID NO: 1513 - protein, 11 aa, Artificial Sequence
  Description of Artificial Sequence: Synthetic peptide
FRIVSGSSMRY

SEQ ID NO: 1514 - protein, 11 aa, Artificial Sequence
  Description of Artificial Sequence: Synthetic peptide
FRTVSGVSMRY

SEQ ID NO: 1515 - protein, 11 aa, Artificial Sequence
  Description of Artificial Sequence: Synthetic peptide
FRTVQGSSMRY

SEQ ID NO: 1516 - protein, 11 aa, Artificial Sequence
  Description of Artificial Sequence: Synthetic peptide
FRTASGSSMRY

SEQ ID NO: 1517 - protein, 11 aa, Artificial Sequence
  Description of Artificial Sequence: Synthetic peptide
FRTVSGSSSRY

SEQ ID NO: 1518 - protein, 11 aa, Artificial Sequence
  Description of Artificial Sequence: Synthetic peptide
FRTVQGSSMRY

SEQ ID NO: 1519 - protein, 11 aa, Artificial Sequence
  Description of Artificial Sequence: Synthetic peptide
FRTVRGSSMRY

SEQ ID NO: 1520 - protein, 11 aa, Artificial Sequence
  Description of Artificial Sequence: Synthetic peptide
FRTKSGSSMRY

SEQ ID NO: 1521 - protein, 11 aa, Artificial Sequence
  Description of Artificial Sequence: Synthetic peptide
FRTVWGSSMRY

SEQ ID NO: 1522 - protein, 11 aa, Artificial Sequence
  Description of Artificial Sequence: Synthetic peptide
FRTRSGSSMRY

SEQ ID NO: 1523 - protein, 11 aa, Artificial Sequence
  Description of Artificial Sequence: Synthetic peptide
FHTVCGTSMGY

SEQ ID NO: 1524 - protein, 11 aa, Artificial Sequence
  Description of Artificial Sequence: Synthetic peptide
FRTVSGSSQRY

SEQ ID NO: 1525 - protein, 11 aa, Artificial Sequence
  Description of Artificial Sequence: Synthetic peptide
FRTVSGSSMSY

SEQ ID NO: 1526 - protein, 11 aa, Artificial Sequence
  Description of Artificial Sequence: Synthetic peptide
FRTVRGSSMRY

SEQ ID NO: 1527 - protein, 11 aa, Artificial Sequence
  Description of Artificial Sequence: Synthetic peptide
FRTQSGSSMRY

SEQ ID NO: 1528 - protein, 11 aa, Artificial Sequence
  Description of Artificial Sequence: Synthetic peptide
FRTLSGSSMRY

SEQ ID NO: 1529 - protein, 11 aa, Artificial Sequence
  Description of Artificial Sequence: Synthetic peptide
FHTVSGSSMRY

SEQ ID NO: 1530 - protein, 11 aa, Artificial Sequence
  Description of Artificial Sequence: Synthetic peptide
FRRVSGSSMRY

SEQ ID NO: 1531 - protein, 11 aa, Artificial Sequence
  Description of Artificial Sequence: Synthetic peptide
FRLVSGSSMRY

SEQ ID NO: 1532 - protein, 11 aa, Artificial Sequence
  Description of Artificial Sequence: Synthetic peptide
FRTVSGSYMRY

SEQ ID NO: 1533 - protein, 11 aa, Artificial Sequence
  Description of Artificial Sequence: Synthetic peptide
FRTVGGSSMRY

SEQ ID NO: 1534 - protein, 11 aa, Artificial Sequence
  Description of Artificial Sequence: Synthetic peptide
FRTHSGSSMRY

SEQ ID NO: 1535 - protein, 11 aa, Artificial Sequence
  Description of Artificial Sequence: Synthetic peptide
FRTVSTSSMRY

SEQ ID NO: 1536 - protein, 11 aa, Artificial Sequence
  Description of Artificial Sequence: Synthetic peptide
FRTVLGTSMRY

SEQ ID NO: 1537 - protein, 11 aa, Artificial Sequence
  Description of Artificial Sequence: Synthetic peptide
FRTVSGSSMRY

SEQ ID NO: 1538 - protein, 11 aa, Artificial Sequence
  Description of Artificial Sequence: Synthetic peptide
FRTVSGSSMGY

SEQ ID NO: 1539 - protein, 11 aa, Artificial Sequence
  Description of Artificial Sequence: Synthetic peptide
FRTVSGSSMRA

SEQ ID NO: 1540 - protein, 11 aa, Artificial Sequence
  Description of Artificial Sequence: Synthetic peptide
FRILSGSSMRY

SEQ ID NO: 1541 - protein, 11 aa, Artificial Sequence
  Description of Artificial Sequence: Synthetic peptide
FRTVQGSSMRY

SEQ ID NO: 1542 - protein, 11 aa, Artificial Sequence
  Description of Artificial Sequence: Synthetic peptide
FRTVSGQSMGY

SEQ ID NO: 1543 - protein, 11 aa, Artificial Sequence
  Description of Artificial Sequence: Synthetic peptide
FRTVSGSSARY

SEQ ID NO: 1544 - protein, 11 aa, Artificial Sequence
  Description of Artificial Sequence: Synthetic peptide
FRYVSGSSMRY

SEQ ID NO: 1545 - protein, 11 aa, Artificial Sequence
  Description of Artificial Sequence: Synthetic peptide
FRTVSGSSMRY

SEQ ID NO: 1546 - protein, 11 aa, Artificial Sequence
  Description of Artificial Sequence: Synthetic peptide
FRRVSGSSMRY

SEQ ID NO: 1547 - protein, 11 aa, Artificial Sequence
  Description of Artificial Sequence: Synthetic peptide
FHTVSGSSMRY

SEQ ID NO: 1548 - protein, 11 aa, Artificial Sequence
  Description of Artificial Sequence: Synthetic peptide
FRQVSGSSMRY

SEQ ID NO: 1549 - protein, 11 aa, Artificial Sequence
  Description of Artificial Sequence: Synthetic peptide
FRTVSGSYMRY

SEQ ID NO: 1550 - protein, 11 aa, Artificial Sequence
  Description of Artificial Sequence: Synthetic peptide
FRTASGSSMRY

SEQ ID NO: 1551 - protein, 11 aa, Artificial Sequence
  Description of Artificial Sequence: Synthetic peptide
FRTVSGHSMRY

SEQ ID NO: 1552 - protein, 11 aa, Artificial Sequence
  Description of Artificial Sequence: Synthetic peptide
FRTVSGSSSRY

SEQ ID NO: 1553 - protein, 11 aa, Artificial Sequence
  Description of Artificial Sequence: Synthetic peptide
FRTVSGSSYSY

SEQ ID NO: 1554 - protein, 11 aa, Artificial Sequence
  Description of Artificial Sequence: Synthetic peptide
FRTVSGSSQSY

SEQ ID NO: 1555 - protein, 9 aa, Artificial Sequence
  Description of Artificial Sequence: Synthetic peptide
YRWTRRYTY

SEQ ID NO: 1556 - protein, 9 aa, Artificial Sequence
  Description of Artificial Sequence: Synthetic peptide
YRWRTRYTY

SEQ ID NO: 1557 - protein, 9 aa, Artificial Sequence
  Description of Artificial Sequence: Synthetic peptide
YRWTTRRTY

SEQ ID NO: 1558 - protein, 9 aa, Artificial Sequence
  Description of Artificial Sequence: Synthetic peptide
YRWTTRYIY

SEQ ID NO: 1559 - protein, 9 aa, Artificial Sequence
  Description of Artificial Sequence: Synthetic peptide
YRWRTRYTY

SEQ ID NO: 1560 - protein, 9 aa, Artificial Sequence
  Description of Artificial Sequence: Synthetic peptide
YRWTRRYTY

SEQ ID NO: 1561 - protein, 9 aa, Artificial Sequence
  Description of Artificial Sequence: Synthetic peptide
YRWRTRYTY

SEQ ID NO: 1562 - protein, 9 aa, Artificial Sequence
  Description of Artificial Sequence: Synthetic peptide
YRWTTRYIY

SEQ ID NO: 1563 - protein, 9 aa, Artificial Sequence
  Description of Artificial Sequence: Synthetic peptide
YRWTTRRTY

SEQ ID NO: 1564 - protein, 9 aa, Artificial Sequence
  Description of Artificial Sequence: Synthetic peptide
YRWRTRYTY

SEQ ID NO: 1565 - protein, 9 aa, Artificial Sequence
  Description of Artificial Sequence: Synthetic peptide
YRWTTRYTY

SEQ ID NO: 1566 - protein, 9 aa, Artificial Sequence
  Description of Artificial Sequence: Synthetic peptide
YRWRTRYTY

SEQ ID NO: 1567 - protein, 9 aa, Artificial Sequence
  Description of Artificial Sequence: Synthetic peptide
YHWTTRYTY

SEQ ID NO: 1568 - protein, 9 aa, Artificial Sequence
  Description of Artificial Sequence: Synthetic peptide
YRWTTRRTY

SEQ ID NO: 1569 - protein, 9 aa, Artificial Sequence
  Description of Artificial Sequence: Synthetic peptide
YRWTTRYTY

SEQ ID NO: 1570 - protein, 9 aa, Artificial Sequence
  Description of Artificial Sequence: Synthetic peptide
YRWTTRYTY

SEQ ID NO: 1571 - protein, 9 aa, Artificial Sequence
  Description of Artificial Sequence: Synthetic peptide
YRWTTRYAY

SEQ ID NO: 1572 - protein, 9 aa, Artificial Sequence
  Description of Artificial Sequence: Synthetic peptide
YRWVTRYTY

SEQ ID NO: 1573 - protein, 9 aa, Artificial Sequence
  Description of Artificial Sequence: Synthetic peptide
YRWVTRYTY

SEQ ID NO: 1574 - protein, 9 aa, Artificial Sequence
  Description of Artificial Sequence: Synthetic peptide
YRWSTRYTY

SEQ ID NO: 1575 - protein, 9 aa, Artificial Sequence
  Description of Artificial Sequence: Synthetic peptide
YRWRTRYTY

SEQ ID NO: 1576 - protein, 9 aa, Artificial Sequence
  Description of Artificial Sequence: Synthetic peptide
YRWTTRGTY

SEQ ID NO: 1577 - protein, 9 aa, Artificial Sequence
  Description of Artificial Sequence: Synthetic peptide
YRWDTRYTY

SEQ ID NO: 1578 - protein, 9 aa, Artificial Sequence
  Description of Artificial Sequence: Synthetic peptide
YRWTTRRTY

SEQ ID NO: 1579 - protein, 9 aa, Artificial Sequence
  Description of Artificial Sequence: Synthetic peptide
YRWRTRYTY

SEQ ID NO: 1580 - protein, 9 aa, Artificial Sequence
  Description of Artificial Sequence: Synthetic peptide
YRWTGRYTY

SEQ ID NO: 1581 - protein, 9 aa, Artificial Sequence
  Description of Artificial Sequence: Synthetic peptide
YRWRTRYTY

SEQ ID NO: 1582 - protein, 9 aa, Artificial Sequence
  Description of Artificial Sequence: Synthetic peptide
YRWRTRYTY

SEQ ID NO: 1583 - protein, 9 aa, Artificial Sequence
  Description of Artificial Sequence: Synthetic peptide
YRWITRYTY

SEQ ID NO: 1584 - protein, 9 aa, Artificial Sequence
  Description of Artificial Sequence: Synthetic peptide
YRWITRYTY

SEQ ID NO: 1585 - protein, 9 aa, Artificial Sequence
  Description of Artificial Sequence: Synthetic peptide
YRWRTRYTY

SEQ ID NO: 1586 - protein, 9 aa, Artificial Sequence
  Description of Artificial Sequence: Synthetic peptide
YRWTRRYTY

SEQ ID NO: 1587 - protein, 9 aa, Artificial Sequence
  Description of Artificial Sequence: Synthetic peptide
YSWTTRYTY

SEQ ID NO: 1588 - protein, 9 aa, Artificial Sequence
  Description of Artificial Sequence: Synthetic peptide
YRWTNRYTY

SEQ ID NO: 1589 - protein, 9 aa, Artificial Sequence
  Description of Artificial Sequence: Synthetic peptide
YRWTTRYRY

SEQ ID NO: 1590 - protein, 9 aa, Artificial Sequence
  Description of Artificial Sequence: Synthetic peptide
YRWTTRYTY

SEQ ID NO: 1591 - protein, 9 aa, Artificial Sequence
  Description of Artificial Sequence: Synthetic peptide
YRWTTRYKY

SEQ ID NO: 1592 - protein, 9 aa, Artificial Sequence
  Description of Artificial Sequence: Synthetic peptide
YRWHTRYTY

SEQ ID NO: 1593 - protein, 9 aa, Artificial Sequence
  Description of Artificial Sequence: Synthetic peptide
YRWTRRYTY

SEQ ID NO: 1594 - protein, 9 aa, Artificial Sequence
  Description of Artificial Sequence: Synthetic peptide
YRWMTRYTY

SEQ ID NO: 1595 - protein, 9 aa, Artificial Sequence
  Description of Artificial Sequence: Synthetic peptide
YRWTTRYRY

SEQ ID NO: 1596 - protein, 9 aa, Artificial Sequence
  Description of Artificial Sequence: Synthetic peptide
YRWSTRYTY

SEQ ID NO: 1597 - protein, 9 aa, Artificial Sequence
  Description of Artificial Sequence: Synthetic peptide
YRWTTRYTF

SEQ ID NO: 1598 - protein, 9 aa, Artificial Sequence
  Description of Artificial Sequence: Synthetic peptide
YRWRTRYTY

SEQ ID NO: 1599 - protein, 9 aa, Artificial Sequence
  Description of Artificial Sequence: Synthetic peptide
YRWTTRRTY

SEQ ID NO: 1600 - protein, 9 aa, Artificial Sequence
  Description of Artificial Sequence: Synthetic peptide
YRWATRYTY

SEQ ID NO: 1601 - protein, 9 aa, Artificial Sequence
  Description of Artificial Sequence: Synthetic peptide
YRWHTRYTY

SEQ ID NO: 1602 - protein, 9 aa, Artificial Sequence
  Description of Artificial Sequence: Synthetic peptide
YRWGTRYTY

SEQ ID NO: 1603 - protein, 9 aa, Artificial Sequence
  Description of Artificial Sequence: Synthetic peptide
YRWTTRNTY

SEQ ID NO: 1604 - protein, 9 aa, Artificial Sequence
  Description of Artificial Sequence: Synthetic peptide
YRWRTRYTY

SEQ ID NO: 1605 - protein, 9 aa, Artificial Sequence
  Description of Artificial Sequence: Synthetic peptide
YRWTTRYAY

SEQ ID NO: 1606 - protein, 9 aa, Artificial Sequence
  Description of Artificial Sequence: Synthetic peptide
YRWRTRYTY

SEQ ID NO: 1607 - protein, 9 aa, Artificial Sequence
  Description of Artificial Sequence: Synthetic peptide
YRWTTRRTY

SEQ ID NO: 1608 - protein, 9 aa, Artificial Sequence
  Description of Artificial Sequence: Synthetic peptide
YRWTTRRTY

SEQ ID NO: 1609 - protein, 9 aa, Artificial Sequence
  Description of Artificial Sequence: Synthetic peptide
YRWTSRYTY

SEQ ID NO: 1610 - protein, 9 aa, Artificial Sequence
  Description of Artificial Sequence: Synthetic peptide
YRWTTRVTY

SEQ ID NO: 1611 - protein, 9 aa, Artificial Sequence
  Description of Artificial Sequence: Synthetic peptide
YRWTTRTTY

SEQ ID NO: 1612 - protein, 9 aa, Artificial Sequence
  Description of Artificial Sequence: Synthetic peptide
YRWRTRYTY

SEQ ID NO: 1613 - protein, 9 aa, Artificial Sequence
  Description of Artificial Sequence: Synthetic peptide
YRWATRYTY

SEQ ID NO: 1614 - protein, 9 aa, Artificial Sequence
  Description of Artificial Sequence: Synthetic peptide
YRWTTRRTY

SEQ ID NO: 1615 - protein, 9 aa, Artificial Sequence
  Description of Artificial Sequence: Synthetic peptide
LRWTTRYTY

SEQ ID NO: 1616 - protein, 9 aa, Artificial Sequence
  Description of Artificial Sequence: Synthetic peptide
YRWTTRGTY

SEQ ID NO: 1617 - protein, 9 aa, Artificial Sequence
  Description of Artificial Sequence: Synthetic peptide
YRWRTRYTY

SEQ ID NO: 1618 - protein, 9 aa, Artificial Sequence
  Description of Artificial Sequence: Synthetic peptide
YRWTTRATY

SEQ ID NO: 1619 - protein, 9 aa, Artificial Sequence
  Description of Artificial Sequence: Synthetic peptide
YRWTTRRTY

SEQ ID NO: 1620 - protein, 9 aa, Artificial Sequence
  Description of Artificial Sequence: Synthetic peptide
YRWPTRYTY

SEQ ID NO: 1621 - protein, 9 aa, Artificial Sequence
  Description of Artificial Sequence: Synthetic peptide
YRWRTRYTY

SEQ ID NO: 1622 - protein, 9 aa, Artificial Sequence
  Description of Artificial Sequence: Synthetic peptide
YRWKTRYTY

SEQ ID NO: 1623 - protein, 9 aa, Artificial Sequence
  Description of Artificial Sequence: Synthetic peptide
YRWSTRYTY

SEQ ID NO: 1624 - protein, 9 aa, Artificial Sequence
  Description of Artificial Sequence: Synthetic peptide
YRWKTRRTY

SEQ ID NO: 1625 - protein, 9 aa, Artificial Sequence
  Description of Artificial Sequence: Synthetic peptide
YRWTTRRTY

SEQ ID NO: 1626 - protein, 9 aa, Artificial Sequence
  Description of Artificial Sequence: Synthetic peptide
YRWTTRYRY

SEQ ID NO: 1627 - protein, 9 aa, Artificial Sequence
  Description of Artificial Sequence: Synthetic peptide
YRWRTRYTY

SEQ ID NO: 1628 - protein, 9 aa, Artificial Sequence
  Description of Artificial Sequence: Synthetic peptide
YRWTTRYKY

SEQ ID NO: 1629 - protein, 9 aa, Artificial Sequence
  Description of Artificial Sequence: Synthetic peptide
YRWKTRYTY

SEQ ID NO: 1630 - protein, 9 aa, Artificial Sequence
  Description of Artificial Sequence: Synthetic peptide
YRWTTRVTY

SEQ ID NO: 1631 - protein, 9 aa, Artificial Sequence
  Description of Artificial Sequence: Synthetic peptide
YRWTTRFTY

SEQ ID NO: 1632 - protein, 9 aa, Artificial Sequence
  Description of Artificial Sequence: Synthetic peptide
YRWTTRFTY

SEQ ID NO: 1633 - protein, 9 aa, Artificial Sequence
  Description of Artificial Sequence: Synthetic peptide
YRWRTRYTY

SEQ ID NO: 1634 - protein, 9 aa, Artificial Sequence
  Description of Artificial Sequence: Synthetic peptide
YRWTTRYTH

SEQ ID NO: 1635 - protein, 9 aa, Artificial Sequence
  Description of Artificial Sequence: Synthetic peptide
YRWTRRYTY

SEQ ID NO: 1636 - protein, 9 aa, Artificial Sequence
  Description of Artificial Sequence: Synthetic peptide
YRWTTRYTY

SEQ ID NO: 1637 - protein, 9 aa, Artificial Sequence
  Description of Artificial Sequence: Synthetic peptide
YRWTTRSTY

SEQ ID NO: 1638 - protein, 9 aa, Artificial Sequence
  Description of Artificial Sequence: Synthetic peptide
YSWTTRYTY

SEQ ID NO: 1639 - protein, 9 aa, Artificial Sequence
  Description of Artificial Sequence: Synthetic peptide
YRWTTRGTY

SEQ ID NO: 1640 - protein, 9 aa, Artificial Sequence
  Description of Artificial Sequence: Synthetic peptide
YRWKTRYTY

SEQ ID NO: 1641 - protein, 9 aa, Artificial Sequence
  Description of Artificial Sequence: Synthetic peptide
YRWTTRFTY

SEQ ID NO: 1642 - protein, 9 aa, Artificial Sequence
  Description of Artificial Sequence: Synthetic peptide
YRWRTRYTY

SEQ ID NO: 1643 - protein, 9 aa, Artificial Sequence
  Description of Artificial Sequence: Synthetic peptide
YRWTTRRTY

SEQ ID NO: 1644 - protein, 9 aa, Artificial Sequence
  Description of Artificial Sequence: Synthetic peptide
YRWSTRYTY

SEQ ID NO: 1645 - protein, 9 aa, Artificial Sequence
  Description of Artificial Sequence: Synthetic peptide
YRWTTRLTY

SEQ ID NO: 1646 - protein, 9 aa, Artificial Sequence
  Description of Artificial Sequence: Synthetic peptide
YRWTRRYTY

SEQ ID NO: 1647 - protein, 9 aa, Artificial Sequence
  Description of Artificial Sequence: Synthetic peptide
YRWTTRLTY

SEQ ID NO: 1648 - protein, 9 aa, Artificial Sequence
  Description of Artificial Sequence: Synthetic peptide
YRWTRRYTY

SEQ ID NO: 1649 - protein, 9 aa, Artificial Sequence
  Description of Artificial Sequence: Synthetic peptide
YRWTTRRTY

SEQ ID NO: 1650 - protein, 9 aa, Artificial Sequence
  Description of Artificial Sequence: Synthetic peptide
YQWTTRYTY

SEQ ID NO: 1651 - protein, 9 aa, Artificial Sequence
  Description of Artificial Sequence: Synthetic peptide
YRWTRRYTY

SEQ ID NO: 1652 - protein, 9 aa, Artificial Sequence
  Description of Artificial Sequence: Synthetic peptide
YRWTTRMTY

SEQ ID NO: 1653 - protein, 9 aa, Artificial Sequence
  Description of Artificial Sequence: Synthetic peptide
YRWTTRRTY

SEQ ID NO: 1654 - protein, 9 aa, Artificial Sequence
  Description of Artificial Sequence: Synthetic peptide
YRWTTRYRY

SEQ ID NO: 1655 - protein, 9 aa, Artificial Sequence
  Description of Artificial Sequence: Synthetic peptide
YRWLTRYTY

SEQ ID NO: 1656 - protein, 9 aa, Artificial Sequence
  Description of Artificial Sequence: Synthetic peptide
YEWTTRYTY

SEQ ID NO: 1657 - protein, 9 aa, Artificial Sequence
  Description of Artificial Sequence: Synthetic peptide
YRWRTRYTY

SEQ ID NO: 1658 - protein, 9 aa, Artificial Sequence
  Description of Artificial Sequence: Synthetic peptide
YRWRTRYTY

SEQ ID NO: 1659 - protein, 9 aa, Artificial Sequence
  Description of Artificial Sequence: Synthetic peptide
YRWRTRYTY

SEQ ID NO: 1660 - protein, 9 aa, Artificial Sequence
  Description of Artificial Sequence: Synthetic peptide
YRWSTRYTY

SEQ ID NO: 1661 - protein, 9 aa, Artificial Sequence
  Description of Artificial Sequence: Synthetic peptide
YRWTTRLTY

SEQ ID NO: 1662 - protein, 9 aa, Artificial Sequence
  Description of Artificial Sequence: Synthetic peptide
YRWTTRLTY

SEQ ID NO: 1663 - protein, 9 aa, Artificial Sequence
  Description of Artificial Sequence: Synthetic peptide
YKWTTRYTY

SEQ ID NO: 1664 - protein, 9 aa, Artificial Sequence
  Description of Artificial Sequence: Synthetic peptide
YRWTTRSTY

SEQ ID NO: 1665 - protein, 9 aa, Artificial Sequence
  Description of Artificial Sequence: Synthetic peptide
YRWRTRYTY

SEQ ID NO: 1666 - protein, 9 aa, Artificial Sequence
  Description of Artificial Sequence: Synthetic peptide
YRWSTRYTY

SEQ ID NO: 1667 - protein, 9 aa, Artificial Sequence
  Description of Artificial Sequence: Synthetic peptide
YRWTTRYTY

SEQ ID NO: 1668 - protein, 9 aa, Artificial Sequence
  Description of Artificial Sequence: Synthetic peptide
YRWRTRYTY

SEQ ID NO: 1669 - protein, 9 aa, Artificial Sequence
  Description of Artificial Sequence: Synthetic peptide
YRWLTRYTY

SEQ ID NO: 1670 - protein, 9 aa, Artificial Sequence
  Description of Artificial Sequence: Synthetic peptide
YRWRTRYTY

SEQ ID NO: 1671 - protein, 9 aa, Artificial Sequence
  Description of Artificial Sequence: Synthetic peptide
YRWTTRYTY

SEQ ID NO: 1672 - protein, 9 aa, Artificial Sequence
  Description of Artificial Sequence: Synthetic peptide
YRWTTRYRY

SEQ ID NO: 1673 - protein, 9 aa, Artificial Sequence
  Description of Artificial Sequence: Synthetic peptide
YRWTTRYTY

SEQ ID NO: 1674 - protein, 9 aa, Artificial Sequence
  Description of Artificial Sequence: Synthetic peptide
YRWPTRYTY

SEQ ID NO: 1675 - protein, 9 aa, Artificial Sequence
  Description of Artificial Sequence: Synthetic peptide
YRWTTRHTY

SEQ ID NO: 1676 - protein, 9 aa, Artificial Sequence
  Description of Artificial Sequence: Synthetic peptide
YRWTRRYTY

SEQ ID NO: 1677 - protein, 9 aa, Artificial Sequence
  Description of Artificial Sequence: Synthetic peptide
YRWHTRYTY

SEQ ID NO: 1678 - protein, 9 aa, Artificial Sequence
  Description of Artificial Sequence: Synthetic peptide
YRWTNRYTY

SEQ ID NO: 1679 - protein, 9 aa, Artificial Sequence
  Description of Artificial Sequence: Synthetic peptide
YRWTTRYRY

SEQ ID NO: 1680 - protein, 9 aa, Artificial Sequence
  Description of Artificial Sequence: Synthetic peptide
YRWTTRRTY

SEQ ID NO: 1681 - protein, 9 aa, Artificial Sequence
  Description of Artificial Sequence: Synthetic peptide
YRWSTRYTY

SEQ ID NO: 1682 - protein, 9 aa, Artificial Sequence
  Description of Artificial Sequence: Synthetic peptide
YRWSTRYTY

SEQ ID NO: 1683 - protein, 9 aa, Artificial Sequence
  Description of Artificial Sequence: Synthetic peptide
YRWRTRYTY

SEQ ID NO: 1684 - protein, 9 aa, Artificial Sequence
  Description of Artificial Sequence: Synthetic peptide
YRWTTRYTY

SEQ ID NO: 1685 - protein, 9 aa, Artificial Sequence
  Description of Artificial Sequence: Synthetic peptide
YEWTTRYTY

SEQ ID NO: 1686 - protein, 9 aa, Artificial Sequence
  Description of Artificial Sequence: Synthetic peptide
YRWTTRSTY

SEQ ID NO: 1687 - protein, 9 aa, Artificial Sequence
  Description of Artificial Sequence: Synthetic peptide
YRWTTRYTY

SEQ ID NO: 1688 - protein, 9 aa, Artificial Sequence
  Description of Artificial Sequence: Synthetic peptide
YRWSTRYTY

SEQ ID NO: 1689 - protein, 9 aa, Artificial Sequence
  Description of Artificial Sequence: Synthetic peptide
YRWSTRYTY

SEQ ID NO: 1690 - protein, 9 aa, Artificial Sequence
  Description of Artificial Sequence: Synthetic peptide
YRWTYRYTY

SEQ ID NO: 1691 - protein, 9 aa, Artificial Sequence
  Description of Artificial Sequence: Synthetic peptide
YRWTTRLTY

SEQ ID NO: 1692 - protein, 9 aa, Artificial Sequence
  Description of Artificial Sequence: Synthetic peptide
YEWTTRYTY

SEQ ID NO: 1693 - protein, 9 aa, Artificial Sequence
  Description of Artificial Sequence: Synthetic peptide
YRWTTRLTY

SEQ ID NO: 1694 - protein, 11 aa, Artificial Sequence
  Description of Artificial Sequence: Synthetic peptide
FRPAAGSPMRY

SEQ ID NO: 1695 - protein, 11 aa, Artificial Sequence
  Description of Artificial Sequence: Synthetic peptide
FRTVDGSPLRY

SEQ ID NO: 1696 - protein, 11 aa, Artificial Sequence
  Description of Artificial Sequence: Synthetic peptide
FRTVSGSSKRY

SEQ ID NO: 1697 - protein, 11 aa, Artificial Sequence
  Description of Artificial Sequence: Synthetic peptide
FSAGSGTEMSY

SEQ ID NO: 1698 - protein, 11 aa, Artificial Sequence
  Description of Artificial Sequence: Synthetic peptide
FGSLSGSSTTY

SEQ ID NO: 1699 - protein, 11 aa, Artificial Sequence
  Description of Artificial Sequence: Synthetic peptide
FGSVSGSWTRY

SEQ ID NO: 1700 - protein, 11 aa, Artificial Sequence
  Description of Artificial Sequence: Synthetic peptide
FRLVSGSSMSY

SEQ ID NO: 1701 - protein, 11 aa, Artificial Sequence
  Description of Artificial Sequence: Synthetic peptide
FRTGSGTSKSY

SEQ ID NO: 1702 - protein, 11 aa, Artificial Sequence
  Description of Artificial Sequence: Synthetic peptide
FSNMSGTTRRY

SEQ ID NO: 1703 - protein, 11 aa, Artificial Sequence
  Description of Artificial Sequence: Synthetic peptide
FRTVPGSAMGY

SEQ ID NO: 1704 - protein, 11 aa, Artificial Sequence
  Description of Artificial Sequence: Synthetic peptide
FRAESGSSMGY

SEQ ID NO: 1705 - protein, 11 aa, Artificial Sequence
  Description of Artificial Sequence: Synthetic peptide
FRTLYGSSRSY

SEQ ID NO: 1706 - protein, 11 aa, Artificial Sequence
  Description of Artificial Sequence: Synthetic peptide
FSPFSGSDTGY

SEQ ID NO: 1707 - protein, 11 aa, Artificial Sequence
  Description of Artificial Sequence: Synthetic peptide
FSTFSGSSISY

SEQ ID NO: 1708 - protein, 11 aa, Artificial Sequence
  Description of Artificial Sequence: Synthetic peptide
FRTLAGSEMRY

SEQ ID NO: 1709 - protein, 11 aa, Artificial Sequence
  Description of Artificial Sequence: Synthetic peptide
FRTVSGSGVRY

SEQ ID NO: 1710 - protein, 11 aa, Artificial Sequence
  Description of Artificial Sequence: Synthetic peptide
FRPGAGHSNSY

SEQ ID NO: 1711 - protein, 11 aa, Artificial Sequence
  Description of Artificial Sequence: Synthetic peptide
FRRASGTAMSY

SEQ ID NO: 1712 - protein, 11 aa, Artificial Sequence
  Description of Artificial Sequence: Synthetic peptide
FTSASGTDLSY

SEQ ID NO: 1713 - protein, 11 aa, Artificial Sequence
  Description of Artificial Sequence: Synthetic peptide
FRSANGSSKRY

SEQ ID NO: 1714 - protein, 11 aa, Artificial Sequence
  Description of Artificial Sequence: Synthetic peptide
FKTIAGAGMRY

SEQ ID NO: 1715 - protein, 11 aa, Artificial Sequence
  Description of Artificial Sequence: Synthetic peptide
FRYGSGSSLSY

SEQ ID NO: 1716 - protein, 11 aa, Artificial Sequence
  Description of Artificial Sequence: Synthetic peptide
FRTVPGASMKY

SEQ ID NO: 1717 - protein, 11 aa, Artificial Sequence
  Description of Artificial Sequence: Synthetic peptide
FRTVDGSAISY

SEQ ID NO: 1718 - protein, 11 aa, Artificial Sequence
  Description of Artificial Sequence: Synthetic peptide
FRTVKGSGGSY

SEQ ID NO: 1719 - protein, 11 aa, Artificial Sequence
  Description of Artificial Sequence: Synthetic peptide
FRTVSGSSRGY

SEQ ID NO: 1720 - protein, 11 aa, Artificial Sequence
  Description of Artificial Sequence: Synthetic peptide
FRPGPGSQMAY

SEQ ID NO: 1721 - protein, 11 aa, Artificial Sequence
  Description of Artificial Sequence: Synthetic peptide
FRTVAGSASGY

SEQ ID NO: 1722 - protein, 11 aa, Artificial Sequence
  Description of Artificial Sequence: Synthetic peptide
FRTVSGSSYSY

SEQ ID NO: 1723 - protein, 11 aa, Artificial Sequence
  Description of Artificial Sequence: Synthetic peptide
FINLKGSSMAY

SEQ ID NO: 1724 - protein, 11 aa, Artificial Sequence
  Description of Artificial Sequence: Synthetic peptide
FRMVTGSYGGY

SEQ ID NO: 1725 - protein, 11 aa, Artificial Sequence
  Description of Artificial Sequence: Synthetic peptide
FKSSYGLPMRY

SEQ ID NO: 1726 - protein, 11 aa, Artificial Sequence
  Description of Artificial Sequence: Synthetic peptide
FKTVSGQSLRY

SEQ ID NO: 1727 - protein, 11 aa, Artificial Sequence
  Description of Artificial Sequence: Synthetic peptide
FRTVTGRAARY

SEQ ID NO: 1728 - protein, 11 aa, Artificial Sequence
  Description of Artificial Sequence: Synthetic peptide
FGPAIGASRTY

SEQ ID NO: 1729 - protein, 11 aa, Artificial Sequence
  Description of Artificial Sequence: Synthetic peptide
FRTVSGAPKSY

SEQ ID NO: 1730 - protein, 11 aa, Artificial Sequence
  Description of Artificial Sequence: Synthetic peptide
FHTVSGSSMSY

SEQ ID NO: 1731 - protein, 11 aa, Artificial Sequence
  Description of Artificial Sequence: Synthetic peptide
FRRLEGYSNRY

SEQ ID NO: 1732 - protein, 11 aa, Artificial Sequence
  Description of Artificial Sequence: Synthetic peptide
FRTGSGSSMGY

SEQ ID NO: 1733 - protein, 11 aa, Artificial Sequence
  Description of Artificial Sequence: Synthetic peptide
FTTVTGSSMSY

SEQ ID NO: 1734 - protein, 9 aa, Artificial Sequence
  Description of Artificial Sequence: Synthetic peptide
YYWTERRPY

SEQ ID NO: 1735 - protein, 9 aa, Artificial Sequence
  Description of Artificial Sequence: Synthetic peptide
YSWDDAHPY

SEQ ID NO: 1736 - protein, 9 aa, Artificial Sequence
  Description of Artificial Sequence: Synthetic peptide
YRWMTRLTY

SEQ ID NO: 1737 - protein, 9 aa, Artificial Sequence
  Description of Artificial Sequence: Synthetic peptide
YDWADAQPY

SEQ ID NO: 1738 - protein, 9 aa, Artificial Sequence
  Description of Artificial Sequence: Synthetic peptide
YSWTDRLPY

SEQ ID NO: 1739 - protein, 9 aa, Artificial Sequence
  Description of Artificial Sequence: Synthetic peptide
YRWATRLPY

SEQ ID NO: 1740 - protein, 9 aa, Artificial Sequence
  Description of Artificial Sequence: Synthetic peptide
YKWSNRLPY

SEQ ID NO: 1741 - protein, 9 aa, Artificial Sequence
  Description of Artificial Sequence: Synthetic peptide
YGWKTRQPY

SEQ ID NO: 1742 - protein, 9 aa, Artificial Sequence
  Description of Artificial Sequence: Synthetic peptide
YRWPNRRGY

SEQ ID NO: 1743 - protein, 9 aa, Artificial Sequence
  Description of Artificial Sequence: Synthetic peptide
YDWTTRQRY

SEQ ID NO: 1744 - protein, 9 aa, Artificial Sequence
  Description of Artificial Sequence: Synthetic peptide
YNWSYAQPY

SEQ ID NO: 1745 - protein, 9 aa, Artificial Sequence
  Description of Artificial Sequence: Synthetic peptide
YNWTDSLQY

SEQ ID NO: 1746 - protein, 9 aa, Artificial Sequence
  Description of Artificial Sequence: Synthetic peptide
YSWTTSLPY

SEQ ID NO: 1747 - protein, 9 aa, Artificial Sequence
  Description of Artificial Sequence: Synthetic peptide
YKWRSRSTY

SEQ ID NO: 1748 - protein, 9 aa, Artificial Sequence
  Description of Artificial Sequence: Synthetic peptide
YSQTTRDPY

SEQ ID NO: 1749 - protein, 9 aa, Artificial Sequence
  Description of Artificial Sequence: Synthetic peptide
YRWTARDTY

SEQ ID NO: 1750 - protein, 9 aa, Artificial Sequence
  Description of Artificial Sequence: Synthetic peptide
YRWTSRLSY

SEQ ID NO: 1751 - protein, 9 aa, Artificial Sequence
  Description of Artificial Sequence: Synthetic peptide
YSWTTRSRY

SEQ ID NO: 1752 - protein, 9 aa, Artificial Sequence
  Description of Artificial Sequence: Synthetic peptide
YNWTSRYRY

SEQ ID NO: 1753 - protein, 9 aa, Artificial Sequence
  Description of Artificial Sequence: Synthetic peptide
YSWKTRFPY

SEQ ID NO: 1754 - protein, 9 aa, Artificial Sequence
  Description of Artificial Sequence: Synthetic peptide
YSWTTRYPY

SEQ ID NO: 1755 - protein, 9 aa, Artificial Sequence
  Description of Artificial Sequence: Synthetic peptide
YEWTNALPY

SEQ ID NO: 1756 - protein, 9 aa, Artificial Sequence
  Description of Artificial Sequence: Synthetic peptide
YSWITRSPY

SEQ ID NO: 1757 - protein, 9 aa, Artificial Sequence
  Description of Artificial Sequence: Synthetic peptide
YSWTTRRQY

SEQ ID NO: 1758 - protein, 9 aa, Artificial Sequence
  Description of Artificial Sequence: Synthetic peptide
YSWITRSPY

SEQ ID NO: 1759 - protein, 9 aa, Artificial Sequence
  Description of Artificial Sequence: Synthetic peptide
YRWEESRQY

SEQ ID NO: 1760 - protein, 9 aa, Artificial Sequence
  Description of Artificial Sequence: Synthetic peptide
YTWTTRLPY

SEQ ID NO: 1761 - protein, 9 aa, Artificial Sequence
  Description of Artificial Sequence: Synthetic peptide
YRWEESRQY

SEQ ID NO: 1762 - protein, 9 aa, Artificial Sequence
  Description of Artificial Sequence: Synthetic peptide
YSWTTRQPY

SEQ ID NO: 1763 - protein, 9 aa, Artificial Sequence
  Description of Artificial Sequence: Synthetic peptide
YVWGTRLPY

SEQ ID NO: 1764 - protein, 9 aa, Artificial Sequence
  Description of Artificial Sequence: Synthetic peptide
YEWTNALPY

SEQ ID NO: 1765 - protein, 9 aa, Artificial Sequence
  Description of Artificial Sequence: Synthetic peptide
YRWEDALTY

SEQ ID NO: 1766 - protein, 9 aa, Artificial Sequence
  Description of Artificial Sequence: Synthetic peptide
YSWTTRYPY

SEQ ID NO: 1767 - protein, 9 aa, Artificial Sequence
  Description of Artificial Sequence: Synthetic peptide
YSWIDSLRY

SEQ ID NO: 1768 - protein, 9 aa, Artificial Sequence
  Description of Artificial Sequence: Synthetic peptide
YSWTTPRAY

SEQ ID NO: 1769 - protein, 115 aa, Artificial Sequence
  Description of Artificial Sequence: Synthetic polypeptide
EVQLVESGGGLVQPGNSLRLSCAASGFTFSRFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 1770 - protein, 115 aa, Artificial Sequence
  Description of Artificial Sequence: Synthetic polypeptide
EVQLVESGGGLVQPGNSLRLSCAASGFTFSKFGMSWVRQAPGKGLEWVSSISGSGADTLYADSLKGRFTISRDNAKTTLYLQMNSLRPEDTAVYYCTIGGSLSKSSQGTLVTVSS

SEQ ID NO: 1771 - protein, 115 aa, Artificial Sequence
  Description of Artificial Sequence: Synthetic polypeptide
EVQLVESGGGLVQPGNSLRLSCAASGFTYSSFGMSWVRQAPGKGLEWVSSISGSGSDTLYADSVKGRFTISRDNAKTTLYLQMNSLRPEDTAVYYCTIGGSLSKSSQGTLVTVSS

SEQ ID NO: 1772 - protein, 115 aa, Artificial Sequence
  Description of Artificial Sequence: Synthetic polypeptide
EVQLVESGGGLVQPGNSLRLSCAASGFTFSKFGMSWVRQAPGKGLEWVSSISGSGTDTLYADSVKGRFTISRDNAKTTLYLQMNSLRPEDTAVYYCTIGGSLSRSSQGTLVTVSS

SEQ ID NO: 1773 - protein, 115 aa, Artificial Sequence
  Description of Artificial Sequence: Synthetic polypeptide
EVQLVESGGGLVQPGNSLRLSCAASGFTFSRFGMSWVRQAPGKGLEWVSSISGSGSDTLYADSVKGRFTISRDNAKTTLYLQMNSLRPEDTAVYYCTIGGSLSKSSQGTLVTVSS

SEQ ID NO: 1774 - protein, 115 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSS

SEQ ID NO: 1775 - protein, 115 aa, Artificial Sequence [sequence omitted]

SEQ ID NO: 1776 - protein, 115 aa, Artificial Sequence
  Description of Artificial Sequence: Synthetic polypeptide
EVQLVESGGGLVQPGNSLRLSCAASGFTFSRFGMSWVRQAPGKGLEWVSSISGSGSDTLYAESVKGRFTISRDNAKTTLYLQMNSLRPEDTAVYYCTIGGSLSRSSQGTLVTVSS

SEQ ID NO: 1777 - protein, 115 aa, Artificial Sequence
  Description of Artificial Sequence: Synthetic polypeptide
EVQLVESGGGLVQPGNSLRLSCAASGFTFSKFGMSWVRQAPGKGLEWVSSISGSGTDTLYAESVKGRFTISRDNAKTTLYLQMNSLRPEDTAVYYCTIGGSLSRSSQGTLVTVSS

SEQ ID NO: 1778 - protein, 115 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 1779 - protein, 10 aa, Artificial Sequence
  Description of Artificial Sequence: Synthetic peptide
GFTFSSFGMS

SEQ ID NO: 1780 - protein, 16 aa, Artificial Sequence
  Description of Artificial Sequence: Synthetic peptide
SISGSGSDTLYADSVK

SEQ ID NO: 1781 - protein, 6 aa, Artificial Sequence
  Description of Artificial Sequence: Synthetic peptide
GGSLSR

SEQ ID NO: 1782 - protein, 10 aa, Artificial Sequence
  Description of Artificial Sequence: Synthetic peptide
GFTFSRFGMS

SEQ ID NO: 1783 - protein, 10 aa, Artificial Sequence
  Description of Artificial Sequence: Synthetic peptide
GFTFSKFGMS

SEQ ID NO: 1784 - protein, 10 aa, Artificial Sequence
  Description of Artificial Sequence: Synthetic peptide
GFTYSSFGMS

SEQ ID NO: 1785 - protein, 16 aa, Artificial Sequence
  Description of Artificial Sequence: Synthetic peptide
SISGSGADTLYADSLK

SEQ ID NO: 1786 - protein, 16 aa, Artificial Sequence
  Description of Artificial Sequence: Synthetic peptide
SISGSGTDTLYADSVK

SEQ ID NO: 1787 - protein, 16 aa, Artificial Sequence
  Description of Artificial Sequence: Synthetic peptide
SISGSGRDTLYADSVK

SEQ ID NO: 1788 - protein, 16 aa, Artificial Sequence
  Description of Artificial Sequence: Synthetic peptide
SISGSGSDTLYAESVK

SEQ ID NO: 1789 - protein, 16 aa, Artificial Sequence
  Description of Artificial Sequence: Synthetic peptide
SISGSGTDTLYAESVK

SEQ ID NO: 1790 - protein, 16 aa, Artificial Sequence
  Description of Artificial Sequence: Synthetic peptide
SISGSGRDTLYAESVK

SEQ ID NO: 1791 - protein, 6 aa, Artificial Sequence
  Description of Artificial Sequence: Synthetic peptide
GGSLSK

SEQ ID NO: 1792 - protein, 6 aa, Artificial Sequence
  Description of Artificial Sequence: Synthetic peptide
GGSLSV

SEQ ID NO: 1793 - protein, 249 aa, Artificial Sequence
  Description of Artificial Sequence: Synthetic polypeptide
EVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVL

SEQ ID NO: 1794 - protein, 249 aa, Artificial Sequence
  Description of Artificial Sequence: Synthetic polypeptide
EVQLVESGGGLVQPGGSLKLSCAASGFEFNKYAMNWVRQAPGKGLEWVARIRSKYNKYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSFGAVTSGNYPNWVQQKPGQAPRGLIGGTKFLAPGTPARFSGSLLGGKAALTLSGVQPEDEAEYYCVLWYDNRWVFGGGTKLTVL

SEQ ID NO: 1795 - protein, 249 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSHISYWAYWGQGTLVTVSSGGGGSGGGGSGGGGSQTVVTQEPSLTVSPGGTVTLTCGSSTGYVTSGNYPNWVQQKPGQAPRGLIGGTSFLAPGTPARFSGSLLGGKAALTLSGVQPEDEAEYYCVLWYSNRWIFGGGTKLTVL

SEQ ID NO: 1796 - protein, 249 aa, Artificial Sequence
  Description of Artificial Sequence: Synthetic polypeptide
EVQLVESGGGLVQPGGSLKLSCAASGFMFNKYAMNWVRQAPGKGLEWVARIRSKSNNYATYYADSVKDRFTISRDDSKNTAYLQMNNLKTEDTAVYYCVRHGNFGNSYISYWATWGQGTLVTVSSGGGGSGGGGSGGGGSQTVVTQEPSLTVSPGGTVTLTCGSSFGAVTSGNYPNWVQQKPGQAPRGLIGGTKLLAPGTPARFSGSLLGGKAALTLSGVQPEDEAEYYCVLWYSNSWVFGGGTKLTVL

SEQ ID NO: 1797 - protein, 249 aa, Artificial Sequence
  Description of Artificial Sequence: Synthetic polypeptide
EVQLVESGGGLVQPGGSLKLSCAASGFTFNTYAMNWVRQAPGKGLEWVARIRSKYNNYATYYKDSVKDRFTISRDDSKNTAYLQMNNLKTEDTAVYYCVRHGNFGNSPISYWAYWGQGTLVTVSSGGGGSGGGGSGGGGSQTVVTQEPSLTVSPGGTVTLTCGSSTGAVVSGNYPNWVQQKPGQAPRGLIGGTEFLAPGTPARFSGSLLGGKAALTLSGVQPEDEAEYYCVLWYSNRWVFGGGTKLTVL

SEQ ID NO: 1798 - protein, 249 aa, Artificial Sequence
  Description of Artificial Sequence: Synthetic polypeptide
EVQLVESGGGLVQPGGSLKLSCAASGFTYNKYAMNWVRQAPGKGLEWVARIRSKYNNYATYYADEVKDRFTISRDDSKNTAYLQMNNLKTEDTAVYYCVRHGNFGNSPISYWAYWGQGTLVTVSSGGGGSGGGGSGGGGSQTVVTQEPSLTVSPGGTVTLTCGSSKGAVTSGNYPNWVQQKPGQAPRGLIGGTKELAPGTPARFSGSLLGGKAALTLSGVQPEDEAEYYCTLWYSNRWVFGGGTKLTVL

SEQ ID NO: 1799 - protein, 249 aa, Artificial Sequence
  Description of Artificial Sequence: Synthetic polypeptide
EVQLVESGGGLVQPGGSLKLSCAASGNTFNKYAMNWVRQAPGKGLEWVARIRSKYNNYETYYADSVKDRFTISRDDSKNTAYLQMNNLKTEDTAVYYCVRHTNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTYFLAPGTPARFSGSLLGGKAALTLSGVQPEDEAEYYCVLWYSNRWVFGGGTKLTVL

SEQ ID NO: 1800 - protein, 249 aa, Artificial Sequence
  Description of Artificial Sequence: Synthetic polypeptide
EVQLVESGGGLVQPGGSLKLSCAASGFTFNNYAMNWVRQAPGKGLEWVARIRSKYNNYATYYADAVKDRFTISRDDSKNTAYLQMNNLKTEDTAVYYCVRHGNFGNSQISYWAYWGQGTLVTVSSGGGGSGGGGSGGGGSQTVVTQEPSLTVSPGGTVTLTCGSSTGAVTDGNYPNWVQQKPGQAPRGLIGGIKFLAPGTPARFSGSLLGGKAALTLSGVQPEDEAEYYCVLWYSNRWVFGGGTKLTVL

SEQ ID NO: 1801 - protein, 249 aa, Artificial Sequence
  Description of Artificial Sequence: Synthetic polypeptide
EVQLVESGGGLVQPGGSLKLSCAASGFTFNKYAVNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGESTGAVTSGNYPNWVQQKPGQAPRGLIGGTKILAPGTPARFSGSLLGGKAALTLSGVQPEDEAEYYCVLWYSNRWVFGGGTKLTVL

SEQ ID NO: 1802 - protein, 249 aa, Artificial Sequence
  Description of Artificial Sequence: Synthetic polypeptide
EVQLVESGGGLVQPGGSLKLSCAASGFTFNKYPMNWVRQAPGKGLEWVARIRSKYNNYATYYADSVKDRFTISRDDSKNTAYLQMNNLKNEDTAVYYCVRHGNFNNSYISYWAYWGQGTLVTVSSGGGGSGGGGSGGGGSQTVVTQEPSLTVSPGGTVTLTCGSSTGAVTKGNYPNWVQQKPGQAPRGLIGGTKMLAPGTPARFSGSLLGGKAALTLSGVQPEDEAEYYCALWYSNRWVFGGGTKLTVL

SEQ ID NO: 1803 - protein, 249 aa, Artificial Sequence
  Description of Artificial Sequence: Synthetic polypeptide
EVQLVESGGGLVQPGGSLKLSCAASGFTFNNYAMNWVRQAPGKGLEWVARIRSGYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSYTGAVTSGNYPNWVQQKPGQAPRGLIGGTKFNAPGTPARFSGSLLGGKAALTLSGVQPEDEAEYYCVLWYANRWVFGGGTKLTVL

SEQ ID NO: 1804 - protein, 249 aa, Artificial Sequence
  Description of Artificial Sequence: Synthetic polypeptide
EVQLVESGGGLVQPGGSLKLSCAASGFEFNKYAMNWVRQAPGKGLEWVARIRSKYNNYETYYADSVKDRFTISRDDSKNTAYLQMNNLKTEDTAVYYCVRHGNFGNSLISYWAYWGQGTLVTVSSGGGGSGGGGSGGGGSQTVVTQEPSLTVSPGGTVTLTCGSSSGAVTSGNYPNWVQQKPGQAPRGLIGGTKFGAPGTPARFSGSLLGGKAALTLSGVQPEDEAEYYCVLWYSNRWVFGGGTKLTVL

SEQ ID NO: 1805 - protein, 249 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1806 - protein, 249 aa, Artificial Sequence
  Description of Artificial Sequence: Synthetic polypeptide
EVQLVESGGGLVQPGGSLKLSCAASGFTFNKYALNWVRQAPGKGLEWVARIRSKYNNYATEYADSVKDRFTISRDDSKNTAYLQMNNLKTEDTAVYYCVRHGNFGNSPISYWAYWGQGTLVTVSSGGGGSGGGGSGGGGSQTVVTQEPSLTVSPGGTVTLTCGSSTGAVTSGNYPNWVQQKPGQAPRGLIGGTNFLAPGTPERFSGSLLGGKAALTLSGVQPEDEAEYYCVLWYSNRWAFGGGTKLTVL

SEQ ID NO: 1807 - protein, 249 aa, Artificial Sequence
  Description of Artificial Sequence: Synthetic polypeptide
EVQLVESGGGLVQPGGSLKLSCAASGFTFNEYAMNWVRQAPGKGLEWVARIRSKYNNYATYYADDVKDRFTISRDDSKNTAYLQMNNLKTEDTAVYYCVRHGNFGNSGISYWAYWGQGTLVTVSSGGGGSGGGGSGGGGSQTVVTQEPSLTVSPGGTVTLTCGSSTGAVTVGNYPNWVQQKPGQAPRGLIGGTEFLAPGTPARFSGSLLGGKAALTLSGVQPEDEAEYYCVLWYSNRWVFGGGTKLTVL

SEQ ID NO: 1808 - protein, 9 aa, Artificial Sequence
  Description of Artificial Sequence: Synthetic peptide
GGGGSGGGS

SEQ ID NO: 1809 - protein, 20 aa, Artificial Sequence
  Description of Artificial Sequence: Synthetic peptide
  MISC_FEATURE (1)..(20): This sequence may encompass 1-10 "Gly Ser" repeating units
GSGSGSGSGSGSGSGSGSGS

SEQ ID NO: 1810 - protein, 30 aa, Artificial Sequence
  Description of Artificial Sequence: Synthetic polypeptide
  MISC_FEATURE (1)..(30): This sequence may encompass 1-10 "Gly Gly Ser" repeating units
GGSGGSGGSGGSGGSGGSGGSGGSGGSGGS

SEQ ID NO: 1811 - protein, 40 aa, Artificial Sequence
  Description of Artificial Sequence: Synthetic polypeptide
  MISC_FEATURE (1)..(40): This sequence may encompass 1-10 "Gly Gly Gly Ser" repeating units
GGGSGGGSGGGSGGGSGGGSGGGSGGGSGGGSGGGSGGGS

SEQ ID NO: 1812 - protein, 40 aa, Artificial Sequence
  Description of Artificial Sequence: Synthetic polypeptide
  MISC_FEATURE (1)..(40): This sequence may encompass 1-10 "Gly Gly Ser Gly" repeating units
GGSGGGSGGGSGGGSGGGSGGGSGGGSGGGSGGGSGGGSG

SEQ ID NO: 1813 - protein, 50 aa, Artificial Sequence
  Description of Artificial Sequence: Synthetic polypeptide
  MISC_FEATURE (1)..(50): This sequence may encompass 1-10 "Gly Gly Ser Gly Gly" repeating units
GGSGGGGSGGGGSGGGGSGGGGSGGGGSGGGGSGGGGSGGGGSGGGGSGG

SEQ ID NO: 1814 - protein, 50 aa, Artificial Sequence
  Description of Artificial Sequence: Synthetic polypeptide
  MISC_FEATURE (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 1815 - protein, 50 aa, Artificial Sequence
  Description of Artificial Sequence: Synthetic polypeptide
  MISC_FEATURE (1)..(50): This sequence may encompass 1-10 "Gly Gly Gly Gly Gly" repeating units
GGGGGGGGGGGGGGGGGGGGGGGGGGGGGGGGGGGGGGGGGGGGGGGGGG

SEQ ID NO: 1816 - protein, 30 aa, Artificial Sequence
  Description of Artificial Sequence: Synthetic polypeptide
  MISC_FEATURE (1)..(30): This sequence may encompass 1-10 "Gly Gly Gly" repeating units
GGGGGGGGGGGGGGGGGGGGGGGGGGGGGG

SEQ ID NO: 1817 - protein, 20 aa, Artificial Sequence
  Description of Artificial Sequence: Synthetic peptide
GGGGSGGGGSGGGGSGGGGS

SEQ ID NO: 1818 - protein, 15 aa, Artificial Sequence
  Description of Artificial Sequence: Synthetic peptide
GGGGSGGGGSGGGGS

SEQ ID NO: 1819 - protein, 6 aa, Artificial Sequence
  Description of Artificial Sequence: Synthetic 6xHis tag
HHHHHH

SEQ ID NO: 1820 - protein, 10 aa, Artificial Sequence
  Description of Artificial Sequence: Synthetic peptide
GNTFNKYAMN

SEQ ID NO: 1821 - protein, 10 aa, Artificial Sequence
  Description of Artificial Sequence: Synthetic peptide
GFEFNKYAMN

SEQ ID NO: 1822 - protein, 10 aa, Artificial Sequence
  Description of Artificial Sequence: Synthetic peptide
GFMFNKYAMN

SEQ ID NO: 1823 - protein, 10 aa, Artificial Sequence
  Description of Artificial Sequence: Synthetic peptide
GFTYNKYAMN

SEQ ID NO: 1824 - protein, 10 aa, Artificial Sequence
  Description of Artificial Sequence: Synthetic peptide
GFTFNNYAMN

SEQ ID NO: 1825 - protein, 10 aa, Artificial Sequence
  Description of Artificial Sequence: Synthetic peptide
GFTFNGYAMN

SEQ ID NO: 1826 - protein, 10 aa, Artificial Sequence
  Description of Artificial Sequence: Synthetic peptide
GFTFNTYAMN

SEQ ID NO: 1827 - protein, 10 aa, Artificial Sequence
  Description of Artificial Sequence: Synthetic peptide
GFTFNEYAMN

SEQ ID NO: 1828 - protein, 10 aa, Artificial Sequence
  Description of Artificial Sequence: Synthetic peptide
GFTFNKYPMN

SEQ ID NO: 1829 - protein, 10 aa, Artificial Sequence
  Description of Artificial Sequence: Synthetic peptide
GFTFNKYAVN

SEQ ID NO: 1830 - protein, 10 aa, Artificial Sequence
  Description of Artificial Sequence: Synthetic peptide
GFTFNKYAIN

SEQ ID NO: 1831 - protein, 10 aa, Artificial Sequence
  Description of Artificial Sequence: Synthetic peptide
GFTFNKYALN

SEQ ID NO: 1832 - protein, 18 aa, Artificial Sequence
  Description of Artificial Sequence: Synthetic peptide
RIRSGYNNYATYYADSVK

SEQ ID NO: 1833 - protein, 18 aa, Artificial Sequence
  Description of Artificial Sequence: Synthetic peptide
RIRSKSNNYATYYADSVK

SEQ ID NO: 1834 - protein, 18 aa, Artificial Sequence
  Description of Artificial Sequence: Synthetic peptide
RIRSKYNKYATYYADSVK

SEQ ID NO: 1835 - protein, 18 aa, Artificial Sequence
  Description of Artificial Sequence: Synthetic peptide
RIRSKYNNYETYYADSVK

SEQ ID NO: 1836 - protein, 18 aa, Artificial Sequence
  Description of Artificial Sequence: Synthetic peptide
RIRSKYNNYATEYADSVK

SEQ ID NO: 1837 - protein, 18 aa, Artificial Sequence
  Description of Artificial Sequence: Synthetic peptide
RIRSKYNNYATYYKDSVK

SEQ ID NO: 1838 - protein, 18 aa, Artificial Sequence
  Description of Artificial Sequence: Synthetic peptide
RIRSKYNNYATYYADEVK

SEQ ID NO: 1839 - protein, 18 aa, Artificial Sequence
  Description of Artificial Sequence: Synthetic peptide
RIRSKYNNYATYYADAVK

SEQ ID NO: 1840 - protein, 18 aa, Artificial Sequence
  Description of Artificial Sequence: Synthetic peptide
RIRSKYNNYATYYADQVK

SEQ ID NO: 1841 - protein, 18 aa, Artificial Sequence
  Description of Artificial Sequence: Synthetic peptide
RIRSKYNNYATYYADDVK

SEQ ID NO: 1842 - protein, 14 aa, Artificial Sequence
  Description of Artificial Sequence: Synthetic peptide
HANFGNSYISYWAY

SEQ ID NO: 1843 - protein, 14 aa, Artificial Sequence
  Description of Artificial Sequence: Synthetic peptide
HTNFGNSYISYWAY

SEQ ID NO: 1844 - protein, 14 aa, Artificial Sequence
  Description of Artificial Sequence: Synthetic peptide
HGNFNNSYISYWAY

SEQ ID NO: 1845 - protein, 14 aa, Artificial Sequence
  Description of Artificial Sequence: Synthetic peptide
HGNFGDSYISYWAY

SEQ ID NO: 1846 - protein, 14 aa, Artificial Sequence
  Description of Artificial Sequence: Synthetic peptide
HGNFGNSHISYWAY

SEQ ID NO: 1847 - protein, 14 aa, Artificial Sequence
  Description of Artificial Sequence: Synthetic peptide
HGNFGNSPISYWAY

SEQ ID NO: 1848 - protein, 14 aa, Artificial Sequence
  Description of Artificial Sequence: Synthetic peptide
HGNFGNSQISYWAY

SEQ ID NO: 1849 - protein, 14 aa, Artificial Sequence
  Description of Artificial Sequence: Synthetic peptide
HGNFGNSLISYWAY

SEQ ID NO: 1850 - protein, 14 aa, Artificial Sequence
  Description of Artificial Sequence: Synthetic peptide
HGNFGNSGISYWAY

SEQ ID NO: 1851 - protein, 14 aa, Artificial Sequence
  Description of Artificial Sequence: Synthetic peptide
HGNFGNSYISYWAT

SEQ ID NO: 1852 - protein, 14 aa, Artificial Sequence
  Description of Artificial Sequence: Synthetic peptide
ASSTGAVTSGNYPN

SEQ ID NO: 1853 - protein, 14 aa, Artificial Sequence
  Description of Artificial Sequence: Synthetic peptide
GESTGAVTSGNYPN

SEQ ID NO: 1854 - protein, 14 aa, Artificial Sequence
  Description of Artificial Sequence: Synthetic peptide
GSYTGAVTSGNYPN

SEQ ID NO: 1855 - protein, 14 aa, Artificial Sequence
  Description of Artificial Sequence: Synthetic peptide
GSSFGAVTSGNYPN

SEQ ID NO: 1856 - protein, 14 aa, Artificial Sequence
  Description of Artificial Sequence: Synthetic peptide
GSSKGAVTSGNYPN

SEQ ID NO: 1857 - protein, 14 aa, Artificial Sequence
  Description of Artificial Sequence: Synthetic peptide
GSSSGAVTSGNYPN

SEQ ID NO: 1858 - protein, 14 aa, Artificial Sequence
  Description of Artificial Sequence: Synthetic peptide
GSSTGYVTSGNYPN

SEQ ID NO: 1859 - protein, 14 aa, Artificial Sequence
  Description of Artificial Sequence: Synthetic peptide
GSSTGAVVSGNYPN

SEQ ID NO: 1860 - protein, 14 aa, Artificial Sequence
  Description of Artificial Sequence: Synthetic peptide
GSSTGAVTDGNYPN

SEQ ID NO: 1861 - protein, 14 aa, Artificial Sequence
  Description of Artificial Sequence: Synthetic peptide
GSSTGAVTKGNYPN

SEQ ID NO: 1862 - protein, 14 aa, Artificial Sequence
  Description of Artificial Sequence: Synthetic peptide
GSSTGAVTHGNYPN

SEQ ID NO: 1863 - protein, 14 aa, Artificial Sequence
  Description of Artificial Sequence: Synthetic peptide
GSSTGAVTVGNYPN

SEQ ID NO: 1864 - protein, 14 aa, Artificial Sequence
  Description of Artificial Sequence: Synthetic peptide
GSSTGAVTSGYYPN

SEQ ID NO: 1865 - protein, 7 aa, Artificial Sequence
  Description of Artificial Sequence: Synthetic peptide
GIKFLAP

SEQ ID NO: 1866 - protein, 7 aa, Artificial Sequence
  Description of Artificial Sequence: Synthetic peptide
GTEFLAP

SEQ ID NO: 1867 - protein, 7 aa, Artificial Sequence
  Description of Artificial Sequence: Synthetic peptide
GTYFLAP

SEQ ID NO: 1868 - protein, 7 aa, Artificial Sequence
  Description of Artificial Sequence: Synthetic peptide
GTSFLAP

SEQ ID NO: 1869 - protein, 7 aa, Artificial Sequence
  Description of Artificial Sequence: Synthetic peptide
GTNFLAP

SEQ ID NO: 1870 - protein, 7 aa, Artificial Sequence
  Description of Artificial Sequence: Synthetic peptide
GTKLLAP

SEQ ID NO: 1871 - protein, 7 aa, Artificial Sequence
  Description of Artificial Sequence: Synthetic peptide
GTKELAP

SEQ ID NO: 1872 - protein, 7 aa, Artificial Sequence
  Description of Artificial Sequence: Synthetic peptide
GTKILAP

SEQ ID NO: 1873 - protein, 7 aa, Artificial Sequence
  Description of Artificial Sequence: Synthetic peptide
GTKMLAP

SEQ ID NO: 1874 - protein, 7 aa, Artificial Sequence
  Description of Artificial Sequence: Synthetic peptide
GTKVLAP

SEQ ID NO: 1875 - protein, 7 aa, Artificial Sequence
  Description of Artificial Sequence: Synthetic peptide
GTKFNAP

SEQ ID NO: 1876 - protein, 7 aa, Artificial Sequence
  Description of Artificial Sequence: Synthetic peptide
GTKFGAP

SEQ ID NO: 1877 - protein, 7 aa, Artificial Sequence
  Description of Artificial Sequence: Synthetic peptide
GTKFLVP

SEQ ID NO: 1878 - protein, 9 aa, Artificial Sequence
  Description of Artificial Sequence: Synthetic peptide
TLWYSNRWV

SEQ ID NO: 1879 - protein, 9 aa, Artificial Sequence
  Description of Artificial Sequence: Synthetic peptide
ALWYSNRWV

SEQ ID NO: 1880 - protein, 9 aa, Artificial Sequence
  Description of Artificial Sequence: Synthetic peptide
VLWYDNRWV

SEQ ID NO: 1881 - protein, 9 aa, Artificial Sequence
  Description of Artificial Sequence: Synthetic peptide
VLWYANRWV

SEQ ID NO: 1882 - protein, 9 aa, Artificial Sequence
  Description of Artificial Sequence: Synthetic peptide
VLWYSNSWV

SEQ ID NO: 1883 - protein, 9 aa, Artificial Sequence
  Description of Artificial Sequence: Synthetic peptide
VLWYSNRWI

SEQ ID NO: 1884 - protein, 9 aa, Artificial Sequence
  Description of Artificial Sequence: Synthetic peptide
VLWYSNRWA

SEQ ID NO: 1885 - protein, 618 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 1886 - protein, 117 aa, Artificial Sequence
  Description of Artificial Sequence: Synthetic polypeptide
EVQLVESGGGLVQPGGSLTLSCAASLSSVSVLSIAWYRQAPGKKRELVAGISTDGSTVYIDSVKGRFTISRDNAKNSVYLQMNSLRAEDTAVYYCYAYSWTTSLPYWGQGTLVTVSS

SEQ ID NO: 1887 - protein, 10 aa, Artificial Sequence
  Description of Artificial Sequence: Synthetic peptide
LSSVSVLSIA

SEQ ID NO: 1888 - protein, 16 aa, Artificial Sequence
  Description of Artificial Sequence: Synthetic peptide
GISTDGSTVYIDSVKG

SEQ ID NO: 1889 - protein, 9 aa, Artificial Sequence
  Description of Artificial Sequence: Synthetic peptide
YSWTTSLPY

SEQ ID NO: 1890 - protein, 505 aa, Artificial Sequence
  Description of Artificial Sequence: Synthetic polypeptide
EVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLTLSCAASSSSVSLLSLAWYRQAPGKKRELVAGISDDGSIVYMDSVKGRFTISRDNAKNSVYLQMNSLRAEDTAVYYCYAYSWITRSPYWGQGTLVTVSSHHHHHH

SEQ ID NO: 1891 - protein, 505 aa, Artificial Sequence
  Description of Artificial Sequence: Synthetic polypeptide
EVQLVESGGGLVQPGGSLTLSCAASSSSVSLLSLAWYRQAPGKKRELVAGISDDGSIVYMDSVKGRFTISRDNAKNSVYLQMNSLRAEDTAVYYCYAYSWITRSPYWGQGTLVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 1892 - protein, 618 aa, Homo sapiens; identical to SEQ ID NO: 1885

SEQ ID NO: 1893 - protein, 446 aa, Homo sapiens
RSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYL

SEQ ID NO: 1894 - protein, 16 aa, Artificial Sequence
  Description of Artificial Sequence: Synthetic peptide
  MOD_RES (2)..(2): I or V
  MOD_RES (4)..(4): A, D, E, G, H, I, K, L, N, P, Q, R, S, T, V, or Y
  MOD_RES (5)..(5): A, D, E, G, H, N, R, or T
  MOD_RES (7)..(7): H, P, R, or S
  MOD_RES (8)..(8): A, H, I, K, M, N, Q, R, T, or V
  MOD_RES (9)..(9): A, D, G, H, I, L, M, N, S, T, V, or Y
  MOD_RES (11)..(11): A, F, I, L, M, R, S, T, V, or Y
  MOD_RES (12)..(12): A, D, E, G, H, K, L, N, R, S, or V
GXSXXGXXXYXXSVKG

SEQ ID NO: 1895 - protein, 16 aa, Artificial Sequence
  Description of Artificial Sequence: Synthetic peptide
  MOD_RES (2)..(2): I or V
  MOD_RES (4)..(4): A, K, P, R, or S
  MOD_RES (5)..(5): D or N
  MOD_RES (6)..(6): D, E, G, K, N, Q, R, S, T, or Y
  MOD_RES (7)..(7): S or T
  MOD_RES (8)..(8): A, E, F, H, I, K, L, N, Q, R, S, T, V, or Y
  MOD_RES (9)..(9): A, I, L, M, V, or Y
  MOD_RES (10)..(10): D, F, H, I, L, N, S, T, V, or Y
  MOD_RES (11)..(11): A, D, E, F, G, I, K, L, N, Q, R, S, T, V, or Y
  MOD_RES (12)..(12): A, D, E, G, K, Q, S, or V
  MOD_RES (14)..(14): A or V
  MOD_RES (16)..(16): G or V
GXSXXXXXXXXXSXKX

SEQ ID NO: 1896 - protein, 5 aa, Artificial Sequence
  Description of Artificial Sequence: Synthetic peptide
LPETG

SEQ ID NO: 1897 - protein, 249 aa, Artificial Sequence
  Description of Artificial Sequence: Synthetic polypeptide
EVQLVESGGGLVQPGGSLKLSCAASGFTFNGYAMNWVRQAPGKGLEWVARIRSKYNNYATYYADEVKDRFTISRDDSKNTAYLQMNNLKTEDTAVYYCVRHGNFGNSPISYWAYWGQGTLVTVSSGGGGSGGGGSGGGGSQTVVTQEPSLTVSPGGTVTLTCGSSTGAVVSGNYPNWVQQKPGQAPRGLIGGTEFLAPGTPARFSGSLLGGKAALTLSGVQPEDEAEYYCVLWYSNRWVFGGGTKLTVL

SEQ ID NO: 1898 - protein, 249 aa, Artificial Sequence
  Description of Artificial Sequence: Synthetic polypeptide
EVQLVESGGGLVQPGGSLKLSCAASGNTFNKYAMNWVRQAPGKGLEWVARIRSKYNNYATYYADSVKDRFTISRDDSKNTAYLQMNNLKTEDTAVYYCVRHGNFGDSYISYWAYWGQGTLVTVSSGGGGSGGGGSGGGGSQTVVTQEPSLTVSPGGTVTLTCGSSTGAVTHGNYPNWVQQKPGQAPRGLIGGTKVLAPGTPARFSGSLLGGKAALTLSGVQPEDEAEYYCVLWYSNRWVFGGGTKLTVL

What is claimed is:

1. A DLL3 targeting trispecific protein, wherein said protein comprises
   (a) a first domain (A) which is a single chain variable fragment that specifically binds to a human CD3;
   (b) a second domain (B) which is a single domain antibody that specifically binds to a human serum albumin protein; and
   (c) a third domain (C) which is a single domain antibody that specifically binds to a DLL3 protein, wherein the third domain (C) comprises a CDR1 that has the amino acid sequence of SEQ ID No. 874, a CDR2 that has the amino acid sequence of SEQ ID No. 1316, and a CDR3 that has the amino acid sequence of SEQ ID No. 1758.

2. The DLL3 targeting trispecific protein of claim 1, wherein the domains are linked in the order H2N-(A)-(B)-(C)-COOH, H2N-(A)-(C)-(B)-COOH, H2N-(B)-(A)-(C)-COOH, H2N-(B)-(C)-(A)-COOH, H2N-(C)-(B)-(A)-COOH, or H2N-(C)-(A)-(B)-COOH, or by linkers L1 and L2, in the order H2N-(A)-L1-(B)-L2-(C)-COOH, H2N-(A)-L1-(C)-L2-(B)-COOH, H2N-(B)-L1-(A)-L2-(C)-COOH, H2N-(B)-L1-(C)-L2-(A)-COOH, H2N-(C)-L1-(B)-L2-(A)-COOH, or H2N-(C)-L1-(A)-L2-(B)-COOH.

3. The DLL3 targeting trispecific protein of claim 1, wherein the domains are linked in the order H2N-(A)-(B)-(C)-COOH or by linkers L1 and L2 in the order of H2N-(A)-L1-(B)-L2-(C)-COOH.

4. The DLL3 targeting trispecific protein of claim 1, wherein the domains are linked in the order H2N-(C)-(B)-(A)-COOH or by linkers L1 and L2 in the order of H2N-(C)-L1-(B)-L2-(A)-COOH.

5. The DLL3 targeting trispecific protein of claim 1, wherein the third domain (C) is an affinity matured binding molecule obtained from a parental molecule that specifically binds to the DLL3 protein.

6. The DLL3 targeting trispecific protein of claim 5, wherein the affinity matured DLL3 binding molecule has a binding affinity toward the DLL3 protein that is about 2-fold about 50-fold greater than the binding affinity of the parental molecule toward the DLL3 protein.

7. The DLL3 targeting trispecific protein of claim 2, wherein the linkers L1 and L2 are each independently selected from the group consisting of $(GS)_n$ (SEQ ID No.1809), $(GGS)_n$ (SEQ ID No.1810), $(GGGS)_n$ (SEQ ID No.1811), $(GGSG)_n$ (SEQ ID No.1812), $(GGSGG)_n$ (SEQ ID No.1813), or $(GGGGS)_n$ (SEQ ID No.1814), wherein n is 1, 2, 3, 4, 5, 6, 7, 8, 9, or 10.

8. The DLL3 targeting trispecific protein of claim 2, wherein the linkers L1 and L2 independently comprises the sequence of GGGGSGGGS (SEQ ID No. 1808).

9. The DLL3 targeting trispecific protein of claim 1, wherein the second domain (B) comprises an amino acid sequence selected from the group consisting of SEQ ID Nos. 1769-1778.

10. The DLL3 targeting trispecific protein of claim 1, wherein the first domain (A) comprises an amino acid sequence selected from the group consisting of SEQ ID Nos. 1793-1802 and 1897-1898.

11. The DLL3 targeting trispecific protein of claim 1, comprising the sequence of SEQ ID No. 1890 or SEQ ID No. 1891.

12. A DLL3 targeting trispecific protein, wherein said protein comprises
    (a) a first domain (A) which is a single chain variable fragment that specifically binds to a human CD3;
    (b) a second domain (B) which is a single domain antibody that specifically binds to a human serum albumin protein; and
    (c) a third domain (C) which is a single domain antibody that specifically binds to DLL3, wherein the third domain (C) comprises a sequence selected from the group consisting of SEQ ID Nos. 408, 425, 432, 430, 431, and 1886.

13. The A DLL3 targeting trispecific protein, comprising the sequence of SEQ ID No. 1890 or SEQ ID No. 1891.

14. A DLL3 single domain antibody comprising a CDR1 that has the amino acid sequence of SEQ ID No. 874, a CDR2 that has the amino acid sequence of SEQ ID No. 1316, and a CDR3 that has the amino acid sequence of SEQ ID No. 1758.

15. The DLL3 single domain antibody of claim 14, wherein the DLL3 single domain antibody comprises a sequence that is at least 80% identical to the amino acid sequence of SEQ ID No. 432.

16. A method of treating a cancer overexpressing DLL3 protein in a subject, comprising administering an effective amount of a DLL3 targeting trispecific protein of claim 1, to the subject.

* * * * *

UNITED STATES PATENT AND TRADEMARK OFFICE
CERTIFICATE OF CORRECTION

PATENT NO. : 10,815,311 B2
APPLICATION NO. : 16/583070
DATED : October 27, 2020
INVENTOR(S) : Holger Wesche et al.

Page 1 of 1

It is certified that error appears in the above-identified patent and that said Letters Patent is hereby corrected as shown below:

In the Claims

In Claim 2:
Replace "is about 2-fold about 50-fold" with --is from about 2-fold to about 50-fold--

In Claim 7:
Replace "selected from the group consisting of (GS)n (SEQ ID No.1809), (GGS)n (SEQ ID No.1810), (GGGS)n (SEQ ID No.1811), (GGSG)n (SEQ ID No.1812), (GGSGG)n (SEQ ID No.1813), or (GGGGS)n (SEQ ID No.1814)" with --selected from the group consisting of (GS)n (SEQ ID No.1809), (GGS)n (SEQ ID No.1810), (GGGS)n (SEQ ID No.1811), (GGSG)n (SEQ ID No.1812), (GGSGG)n (SEQ ID No.1813), and (GGGGS)n (SEQ ID No.1814)--

In Claim 13:
Replace "The A" with --A--

In Claim 16:
Replace "claim 1," with --claim 1--

Signed and Sealed this
Fifteenth Day of February, 2022

Drew Hirshfeld
*Performing the Functions and Duties of the
Under Secretary of Commerce for Intellectual Property and
Director of the United States Patent and Trademark Office*